United States Patent 11,446,398 (REGULATED BIOCIRCUIT SYSTEMS) - sequence listing, part 3

SEQ ID NO: 5539 - protein, 302 aa, Homo sapiens
  Payload ID: 1201;
  Gene Symbol: MFI2;
  Gene Name: antigen p97 (melanoma associated) identified by monoclonal antibodies 133.2 and 96.5;
  Uniprot ID:  P08582;
  ENSP ID: ENSP00000296351
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDESPSRRQTWTRSEEEEGECPAHEEARRTMRSSAGQAWKWAPVHRPQDESDKGEFGKRAKSRDMLG

SEQ ID NO: 5540 - protein, 181 aa, Homo sapiens
  Payload ID: 1201;
  Gene Symbol: MFI2;
  Gene Name: antigen p97 (melanoma associated) identified by monoclonal antibodies 133.2 and 96.5;
  ENSP ID: ENSP00000393439
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKGPKRGADLHPESSQVAHQP

SEQ ID NO: 5541 - protein, 560 aa, Homo sapiens
  Payload ID: 1202;
  Gene Symbol: AMH;
  Gene Name: anti-Mullerian hormone;
  Uniprot ID:  P03971;
  ENSP ID: ENSP00000221496
MRDLPLTSLALVLSALGALLGTEALRAEEPAVGTSGLIFREDLDWPPGSPQEPLCLVALGGDSNGSSSPLRVVGALSAYEQAFLGAVQRARWGPRDLATFGVCNTGDRQAALPSLRRLGAWLRDPGGQRLVVLHLEEVTWEPTPSLRFQEPPPGGAGPPELALLVLYPGPGPEVTVTRAGLPGAQSLCPSRDTRYLVLAVDRPAGAWRGSGLALTLQPRGEDSRLSTARLQALLFGDDHRCFTRMTPALLLLPRSEPAPLPAHGQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQVRGAALARPPCCVPTAYAGKLLISLSEERISAHHVPNMVATECGCR

SEQ ID NO: 5542 - protein, 573 aa, Homo sapiens
  Payload ID: 1203;
  Gene Symbol: AMHR2;
  Gene Name: anti-Mullerian hormone receptor, type II;
  Uniprot ID:  Q16671;
  ENSP ID: ENSP00000257863
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPDSSPPPFQLAYEAELGNTPTSDELWALAVQERRRPYIPSTWRCFATDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 5543 - protein, 478 aa, Homo sapiens
  Payload ID: 1203;
  Gene Symbol: AMHR2;
  Gene Name: anti-Mullerian hormone receptor, type II;
  Uniprot ID:  Q16671;
  ENSP ID: ENSP00000369117
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 5544 - protein, 478 aa, Homo sapiens
  Payload ID: 1203;
  Gene Symbol: AMHR2;
  Gene Name: anti-Mullerian hormone receptor, type II;
  Uniprot ID:  Q16671;
  ENSP ID: ENSP00000446661
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPAVHHPSNWPMRQNWAIPLPLMSYGPWQCRRGGVPTSHPPGAALPQTLMG

SEQ ID NO: 5545 - protein, 172 aa, Homo sapiens
  Payload ID: 1203;
  Gene Symbol: AMHR2;
  Gene Name: anti-Mullerian hormone receptor, type II;
  ENSP ID: ENSP00000455338
MALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPDSSPPPFQLAYEAELGNTPTSDELWALAVQERRRPYIPSTWRCFAT

SEQ ID NO: 5546 - protein, 68 aa, Homo sapiens
  Payload ID: 1204;
  Gene Symbol: ATOX1;
  Gene Name: antioxidant 1 copper chaperone;
  Uniprot ID:  O00244;
  ENSP ID: ENSP00000316854
MPKHEFSVDMTCGGCAEAVSRVLNKLGGVKYDIDLPNKKVCIESEHSMDTLLATLKKTGKTVSYLGLE

SEQ ID NO: 5547 - protein, 73 aa, Homo sapiens
  Payload ID: 1204;
  Gene Symbol: ATOX1;
  Gene Name: antioxidant 1 copper chaperone;
  ENSP ID: ENSP00000429366
MKAESPGKHEFSVDMTCGGCAEAVSRVLNKLGGVKYDIDLPNKKVCIESEHSMDTLLATLKKTGKTVSYLGLE

SEQ ID NO: 5548 - protein, 68 aa, Homo sapiens; identical to SEQ ID NO: 5546
  Payload ID: 1204;
  Gene Symbol: ATOX1;
  Gene Name: antioxidant 1 copper chaperone;
  Uniprot ID:  O00244;
  ENSP ID: ENSP00000429814

SEQ ID NO: 5549 - protein, 59 aa, Homo sapiens
  Payload ID: 1204;
  Gene Symbol: ATOX1;
  Gene Name: antioxidant 1 copper chaperone;
  ENSP ID: ENSP00000429982
MTCGGCAEAVSRVLNKLGGVKYDIDLPNKKVCIESEHSMDTLLATLKKTGKTVSYLGLE

SEQ ID NO: 5550 - protein, 59 aa, Homo sapiens; identical to SEQ ID NO: 5549
  Payload ID: 1204;
  Gene Symbol: ATOX1;
  Gene Name: antioxidant 1 copper chaperone;
  ENSP ID: ENSP00000430028

SEQ ID NO: 5551 - protein, 68 aa, Homo sapiens; identical to SEQ ID NO: 5546
  Payload ID: 1204;
  Gene Symbol: ATOX1;
  Gene Name: antioxidant 1 copper chaperone;
  Uniprot ID:  O00244;
  ENSP ID: ENSP00000430598

SEQ ID NO: 5552 - protein, 204 aa, Homo sapiens
  Payload ID: 1205;
  Gene Symbol: ASF1A;
  Gene Name: anti-silencing function 1A histone chaperone;
  Uniprot ID:  Q9Y294;
  ENSP ID: ENSP00000229595
MAKVQVNNVVVLDNPSPFYNPFQFEITFECIEDLSEDLEWKIIYVGSAESEEYDQVLDSVLVGPVPAGRHMFVFQADAPNPGLIPDADAVGVTVVLITCTYRGQEFIRVGYYVNNEYTETELRENPPVKPDFSKLQRNILASNPRVTRFHINWEDNTEKLEDAESSNPNLQSLLSTDALPSASKGWSTSENSLNVMLESHMDCM

SEQ ID NO: 5553 - protein, 202 aa, Homo sapiens
  Payload ID: 1206;
  Gene Symbol: ASF1B;
  Gene Name: anti-silencing function 1B histone chaperone;
  Uniprot ID:  Q9NVP2;
  ENSP ID: ENSP00000263382
MAKVSVLNVAVLENPSPFHSPFRFEISFECSEALADDLEWKIIYVGSAESEEFDQILDSVLVGPVPAGRHMFVFQADAPNPSLIPETDAVGVTVVLITCTYHGQEFIRVGYYVNNEYLNPELRENPPMKPDFSQLQRNILASNPRVTRFHINWDNNMDRLEAIETQDPSLGCGLPLNCTPIKGLGLPGCIPGLLPENSMDCI

SEQ ID NO: 5554 - protein, 81 aa, Homo sapiens
  Payload ID: 1206;
  Gene Symbol: ASF1B;
  Gene Name: anti-silencing function 1B histone chaperone;
  ENSP ID: ENSP00000464802
MAKVSVLNVAVLENPSPFHSPFRFEISFECSEALADDLEWKIIYVGSAESEEFDQILDSVLVGPVPAGRHMFVFQRLMPWV

SEQ ID NO: 5555 - protein, 165 aa, Homo sapiens
  Payload ID: 1206;
  Gene Symbol: ASF1B;
  Gene Name: anti-silencing function 1B histone chaperone;
  ENSP ID: ENSP00000466257
MAKVSVLNVAVLENPSPFHSPFRFEISFECSEALADDLEWKIIYVGSAESEEFDQILDSVLVGPVPAGRHMFVFQADAPNPSLIPETDAVGVTVVLITCTYHGQEFIRVGYYVNNEYLNPELRENPPMKPDFSQVGPVSTSCFPQGRSLYLGGVQPFKLRVKVTS

SEQ ID NO: 5556 - protein, 48 aa, Homo sapiens
  Payload ID: 1206;
  Gene Symbol: ASF1B;
  Gene Name: anti-silencing function 1B histone chaperone;
  ENSP ID: ENSP00000466409
MAKVSVLNVAVLENPSPFHSPFRFEISFECSEALADGRRPQPIPHPRD

SEQ ID NO: 5557 - protein, 143 aa, Homo sapiens
  Payload ID: 1206;
  Gene Symbol: ASF1B;
  Gene Name: anti-silencing function 1B histone chaperone;
  ENSP ID: ENSP00000468513
MAKVSVLNVAVLENPSPFHSPFRFEISFECSEALADDLEWKIIYVGSAESEEFDQILDSVLVGPVPAGRHMFVFQLQRNILASNPRVTRFHINWDNNMDRLEAIETQDPSLGCGLPLNCTPIKGLGLPGCIPGLLPENSMDCI

SEQ ID NO: 5558 - protein, 448 aa, Homo sapiens
  Payload ID: 1207;
  Gene Symbol: AZIN1;
  Gene Name: antizyme inhibitor 1;
  Uniprot ID:  O14977;
  ENSP ID: ENSP00000321507
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 5559 - protein, 448 aa, Homo sapiens; identical to SEQ ID NO: 5558
  Payload ID: 1207;
  Gene Symbol: AZIN1;
  Gene Name: antizyme inhibitor 1;
  Uniprot ID:  O14977;
  ENSP ID: ENSP00000337180

SEQ ID NO: 5560 - protein, 33 aa, Homo sapiens
  Payload ID: 1207;
  Gene Symbol: AZIN1;
  Gene Name: antizyme inhibitor 1;
  ENSP ID: ENSP00000429215
MKGFIDDANYSVGLLDEGTNLGNVIDNYVYEHT

SEQ ID NO: 5561 - protein, 97 aa, Homo sapiens
  Payload ID: 1207;
  Gene Symbol: AZIN1;
  Gene Name: antizyme inhibitor 1;
  ENSP ID: ENSP00000429449
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMAL

SEQ ID NO: 5562 - protein, 165 aa, Homo sapiens
  Payload ID: 1207;
  Gene Symbol: AZIN1;
  Gene Name: antizyme inhibitor 1;
  ENSP ID: ENSP00000475919
MKGFIDDANYSVGLLDEGTNLGNVIDNYVYEHTLNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAG

SEQ ID NO: 5563 - protein, 460 aa, Homo sapiens
  Payload ID: 1208;
  Gene Symbol: AZIN2;
  Gene Name: antizyme inhibitor 2;
  Uniprot ID:  Q96A70;
  ENSP ID: ENSP00000294517
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 5564 - protein, 204 aa, Homo sapiens
  Payload ID: 1208;
  Gene Symbol: AZIN2;
  Gene Name: antizyme inhibitor 2;
  Uniprot ID:  Q96A70;
  ENSP ID: ENSP00000362539
MAGYLSESDFVMVEEGFSTRDLLKELTLGASQATTDEVAAFFVADLGAIVRKHFCFLKCLPRVRPFYAVKCNSSPGVLKVLAQLGLGFSCANKIASVINSALDLYFPEGCGVDIFAELGRYYVTSAFTVAVSIIAKKEVLLDQPGREEENGSTSKTIVYHLDEGVYGIFNSVLFDNICPTPILQKSKNHSPCYMSLESIHFIAV

SEQ ID NO: 5565 - protein, 480 aa, Homo sapiens
  Payload ID: 1208;
  Gene Symbol: AZIN2;
  Gene Name: antizyme inhibitor 2;
  Uniprot ID:  Q96A70;
  ENSP ID: ENSP00000362540
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREAPLPPPHIATCAASEPSPPAEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 5566 - protein, 460 aa, Homo sapiens; identical to SEQ ID NO: 5563
  Payload ID: 1208;
  Gene Symbol: AZIN2;
  Gene Name: antizyme inhibitor 2;
  Uniprot ID:  Q96A70;
  ENSP ID: ENSP00000362542

SEQ ID NO: 5567 - protein, 297 aa, Homo sapiens
  Payload ID: 1209;
  Gene Symbol:;
  Gene Name: AP000275.65;
  ENSP ID: ENSP00000391771
  MOD_RES (1)..(1): Any amino acid
XVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQRGQGAPAREPIISSEEQKQLMLYYHRRQEELKPLQQQIIRLHQELGRQKSLWADVHGKLRSHIDALREQNMELREKLRALQLQRWKARKKSAASPHAGQESHTLALE

SEQ ID NO: 5568 - protein, 297 aa, Homo sapiens
  Payload ID: 1209;
  Gene Symbol:;
  Gene Name: AP000275.65;
  ENSP ID: ENSP00000446874
MVLLHVKRGDESQFLLQAPGSTELEELTVQVARVYNGRLKVQRLCSEMEELAEHGIFLPPNMQGLTDDQIEELKLKDEWGEKCVPSGGAVFKKDDIGRRNGQAPNEKMKQVLKKTIEEAKAIISKKQVEAGVCVTMEMVKDALDQLRGAVMIVYPMGLPPYDPIRMEFENKEDLSGTQAGLNVIKEAEAQLWWAAKELRRTKKLSDYVGKNEKTKIIAKIQQPLQQQIIRLHQELGRQKSLWADVHGKLRSHIDALREQNMELREKLRALQLQRWKARKKSAASPHAGQESHTLALE

SEQ ID NO: 5569 - protein, 333 aa, Homo sapiens
  Payload ID: 1210;
  Gene Symbol:;
  Gene Name: AP000295.9;
  ENSP ID: ENSP00000388223
  MOD_RES (1)..(1): Any amino acid
XDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWS

SEQ ID NO: 5570 - protein, 112 aa, Homo sapiens
  Payload ID: 1210;
  Gene Symbol:;
  Gene Name: AP000295.9;
  ENSP ID: ENSP00000413946
  MOD_RES (1)..(1): Any amino acid
XEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESVIGYSKINA

SEQ ID NO: 5571 - protein, 242 aa, Homo sapiens
  Payload ID: 1211;
  Gene Symbol:;
  Gene Name: AP000304.12;
  ENSP ID: ENSP00000394107
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPLTTNLINLLAENGRLSNTQGVVSAFSTMMSVHRGEVPCTVTSASTSHVSFSEPDIPSSKSTELPVDWSIKTRLLFTSSQPFTWADHLKAQEEAQGLVQHCRATEVTLPKSIQDPKLSSELRCTFQQSLIYWLHPALSWL

SEQ ID NO: 5572 - protein, 139 aa, Homo sapiens
  Payload ID: 1212;
  Gene Symbol:;
  Gene Name: AP000322.53;
  Uniprot ID:  A8MWV9;
  ENSP ID: ENSP00000397039
MEWAKWTPHEASNQTQASTLLGLLLGDHTEGRNDTNSTRALKVPDGTSAAWYILTIIGIYAVIFVFRLASNILRKNDKSLEDVYYSNLTSELKMTGLQGKVAKCSTLSISNRAVLQPCQAHLGAKGGSSGPQTATPETP

SEQ ID NO: 5573 - protein, 249 aa, Homo sapiens
  Payload ID: 1213;
  Gene Symbol:;
  Gene Name: AP000349.1;
  ENSP ID: ENSP00000469183
MGPQHPCFSASPWKEPHNRDTARTLQFPQSCHGATLRDRDGDRAARFARTCIAGPRLPFLLSHAKASLPSLRQSLAGDHDLRGPPGSCHGGCTPPHPPEETWAQSHAWCPQPQRWPWVSSLIFVAWQGSAPLRASKPWSEESVGRLGTAKEVRTHETGEAFQSLHLHRVKLPVEAAAQEVGIAISILEGSVDLRGHPSPVSGCGARDCLHAGCWGGNASSPCLGRSRSCSSRDPRPRQHGPGTSPGPAR

SEQ ID NO: 5574 - protein, 249 aa, Homo sapiens; identical to SEQ ID NO: 5573
  Payload ID: 1214;
  Gene Symbol:;
  Gene Name: AP000349.2;
  ENSP ID: ENSP00000485053

SEQ ID NO: 5575 - protein, 209 aa, Homo sapiens
  Payload ID: 1215;
  Gene Symbol:;
  Gene Name: AP000350.10;
  ENSP ID: ENSP00000400325
NAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLSTSRCTWSRTSSWPSAAPASRARSAACTASARSAARRTAPTASCCAACWPSACASARTGSTSTITT

SEQ ID NO: 5576 - protein, 209 aa, Homo sapiens; identical to SEQ ID NO: 5575
  Payload ID: 1215;
  Gene Symbol:;
  Gene Name: AP000350.10;
  ENSP ID: ENSP00000487472

SEQ ID NO: 5577 - protein, 36 aa, Homo sapiens
  Payload ID: 1216;
  Gene Symbol:;
  Gene Name: AP000351.1;
  ENSP ID: ENSP00000483993
QVAFGQDYCTTVPSPEYYSKTQSEHSIPANSLKPST

SEQ ID NO: 5578 - protein, 124 aa, Homo sapiens
  Payload ID: 1217;
  Gene Symbol:;
  Gene Name: AP000687.1;
  ENSP ID: ENSP00000485343
MTLNEHAAFKHLFNKAHLAPPLIHLTLSGHSTCFREHRVGGKVTDQQDPKAEEFFLVQNKIKSLPCLLLSTQTQQPSDFSIFSPPFPSFDSTKPPLSSWPVLNELLGTPPRRGGGRAEGLLTSQ

SEQ ID NO: 5579 - protein, 164 aa, Homo sapiens
  Payload ID: 1218;
  Gene Symbol:;
  Gene Name: AP000721.4;
  ENSP ID: ENSP00000475957
MSVLTPLLLRGLTGSARRLPVPRAKIHSLPPEGKLGIMGKENGIGSRRICNHHRELWEAGKMEPNQCVGWRCGSGAAGLSYRSQVRRPGVPAPATGLEAHSLTTPKGIPLLGLLPRRGNEEGLASGRTAIGNPEAVGSAALFKDGGGGTSAAEAGAAGQRLRRC

SEQ ID NO: 5580 - protein, 67 aa, Homo sapiens [sequence omitted]

SEQ ID NO: 5581 - protein, 14 aa, Homo sapiens
  Payload ID: 1220;
  Gene Symbol:;
  Gene Name: AP001888.1;
  ENSP ID: ENSP00000487309
LSIRQWKSLDTPPG

SEQ ID NO: 5582 - protein, 140 aa, Homo sapiens
  Payload ID: 1221;
  Gene Symbol:;
  Gene Name: AP002884.2;
  ENSP ID: ENSP00000456434
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHCLQCQIVHSCPLLENQIHLSLKFPDYFIKMKPWRKI

SEQ ID NO: 5583 - protein, 140 aa, Homo sapiens; identical to SEQ ID NO: 5582
  Payload ID: 1221;
  Gene Symbol:;
  Gene Name: AP002884.2;
  ENSP ID: ENSP00000456957

SEQ ID NO: 5584 - protein, 313 aa, Homo sapiens
  Payload ID: 1222;
  Gene Symbol:;
  Gene Name: AP002962.1;
  ENSP ID: ENSP00000485529
MQEADASIKTAETKGRTWKYQNIEPGGGPQTSGKGGFGSLVLVFLGQRVGCNETGSMNLEKLQTRPNMTIFTRNNIATNFSSSSSSSYFSPPPPPVLLPLLLLLPQLFSSSSSSFFFSFSPSTSPLVSPCFFSSSSSFCFSVSLLPSSSPTSMTKFPKAVTTKIKTDKRDLIKLKGFCTAKETINRTNRQPIEWEKIFTNYASNKGLISRIYKELGQSDKQRPNNPIKKWAKDMNRHFSKEDIQVANKHEKMLSTSLIIGKMQIKTTVRYHLMPARKATIKKSENNRCWQGCRGKGTFTHCWSKCKLKCKCKM

SEQ ID NO: 5585 - protein, 80 aa, Homo sapiens
  Payload ID: 1223;
  Gene Symbol:;
  Gene Name: AP003419.11;
  ENSP ID: ENSP00000480527
MDLRAGEEPQPRDEEEAELELLRQFDLAWQYGPCTGITRLQRWCRAKQMGLEPPPEVWQVLKTHPGDPRFQCSLWHLYPL

SEQ ID NO: 5586 - protein, 62 aa, Homo sapiens
  Payload ID: 1224;
  Gene Symbol:;
  Gene Name: AP005242.1;
  ENSP ID: ENSP00000485358
MLKIAVMEVPQSAWKTVWMEVAWPHCHVPLSLKKRHICLWARQYIHLVYVYTLVYAFCYLTF

SEQ ID NO: 5587 - protein, 198 aa, Homo sapiens; identical to SEQ ID NO: 1160
  Payload ID: 1225;
  Gene Symbol:;
  Gene Name: AP006285.1;
  ENSP ID: ENSP00000483175

SEQ ID NO: 5588 - protein, 198 aa, Homo sapiens; identical to SEQ ID NO: 1160
  Payload ID: 1226;
  Gene Symbol:;
  Gene Name: AP006285.2;
  ENSP ID: ENSP00000485085

SEQ ID NO: 5589 - protein, 863 aa, Homo sapiens
  Payload ID: 1227;
  Gene Symbol: AAK1;
  Gene Name: AP2 associated kinase 1;
  Uniprot ID:  Q2M2I8;
  ENSP ID: ENSP00000385181
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQKPAIAQFPVVSQGGSQQQLMQNFYQQQQQQQQQQQQQQLATALHQQQLMTQQAALQQKPTMAAGQQPQPQPAAAPQPAPAQEPAIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTAEKRKGGQTVDSGLPLLSVSDPFIPLQVPDAPEKLIEGLKSPDTSLLLPDLLPMTDPFGSTSDAVIGKVIISVSSVMHDMCACFKNDKYLVNQSLGNSPATPEAKAI

SEQ ID NO: 5590 - protein, 674 aa, Homo sapiens
  Payload ID: 1227;
  Gene Symbol: AAK1;
  Gene Name: AP2 associated kinase 1;
  ENSP ID: ENSP00000386342
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQKPAIAQFPVVSQGGSQQQLMQNFYQQQQQQQQQQQQQQLATALHQQQLMTQQAALQQKPTMAAGQQPQPQPAAAPQPAPAQEPAIQAPVRQQPKVQTTPPPAVQGQKVGSLTPPSSPKTQRAGHRRILSDVTHSAVFGVPASKSTQLLQAAAAEAELLDPGRQTLQ

SEQ ID NO: 5591 - protein, 961 aa, Homo sapiens
  Payload ID: 1227;
  Gene Symbol: AAK1;
  Gene Name: AP2 associated kinase 1;
  Uniprot ID:  Q2M2I8;
  ENSP ID: ENSP00000386456
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQKPAIAQFPVVSQGGSQQQLMQNFYQQQQQQQQQQQQQQLATALHQQQLMTQQAALQQKPTMAAGQQPQPQPAAAPQPAPAQEPAIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTAEKRKGGQTVDSGLPLLSVSDPFIPLQVPDAPEKLIEGLKSPDTSLLLPDLLPMTDPFGSTSDAVIEKADVAVESLIPGLEPPVPQRLPSQTESVTSNRTDSLTGEDSLLDCSLLSNPTTDLLEEFAPTAISAPVHKAAEDSNLISGFDVPEGSDKVAEDEFDPIPVLITKNPQGGHSRNSSGSSESSLPNLARSLLLVDQLIDL

SEQ ID NO: 5592 - protein, 339 aa, Homo sapiens
  Payload ID: 1227;
  Gene Symbol: AAK1;
  Gene Name: AP2 associated kinase 1;
  ENSP ID: ENSP00000485296
TQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTDLQRESNPCPVITVEHFKESLGVKGLPLYPDPSRVPGTKTQNNLESDYLARDGPSSNSSFHSSEEEGTDLEGDMLDCSGSRPLLMESEEEDESCRPPPGKLGGAVPFAPPEVSPEQAKTVQGGRKNQFQAFTQPATDGLSEPDVFAIAPFRSSRVPNDDMDIFSKAPFVSKSSMAPSQPEESDVFLRAPFTKKKSMEELTVIQCTSQELPAQTGLLSQTGDVPLPAGRERAVYTS

SEQ ID NO: 5593 - protein, 511 aa, Homo sapiens
  Payload ID: 1227;
  Gene Symbol: AAK1;
  Gene Name: AP2 associated kinase 1;
  ENSP ID: ENSP00000485350
TQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTAEKRKGGQTVDSGLPLLSVSDPFIPLQVPDAPDLQRESNPCPVITVEHFKESLGVKGLPLYPDPSRVPGTKTQNNLESDYLARDGPSSNSSFHSSEEEGTDLEGDMLDCSGSRPLLMESEEEDESCRPPPGKLGGAVPFAPPEVSPEQAKTVQGGRKNQFQAFTQPATDGLSEPDVFAIAPFRSSRVPNDDMDIFSKAPFVSKSSMAPSQPEESDVFLRAPFTKKKSMEELTVIQCTSQELPAQTGLLSQTGDVPLPAGRERAVYTSVQAQYSTAGFVQQSNLLSHSVQAADHLDSISPRGSCLESGGHSNDRNKGPQLQKEAVSGPMAGKPFRPQSLSKYSRHYSPEDEPSPEAQPIAAYKIVSQTNKQSIAGSVSITSLSSRTTELPAADPFALAPFPSKSGKKP

SEQ ID NO: 5594 - protein, 99 aa, Homo sapiens
  Payload ID: 1227;
  Gene Symbol: AAK1;
  Gene Name: AP2 associated kinase 1;
  ENSP ID: ENSP00000485409
AAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTV

SEQ ID NO: 5595 - protein, 242 aa, Homo sapiens
  Payload ID: 1228;
  Gene Symbol: APIP;
  Gene Name: APAF1 interacting prt;
  Uniprot ID:  Q96GX9;
  ENSP ID: ENSP00000379133
MSGCDAREGDCCSRRCGAQDKEHPRYLIPELCKQFYHLGWVTGTGGGISLKHGDEIYIAPSGVQKERIQPEDMFVCDINEKDISGPSPSKKLKKSQCTPLFMNAYTMRGAGAVIHTHSKAAVMATLLFPGREFKITHQEMIKGIKKCTSGGYYRYDDMLVVPIIENTPEEKDLKDRMAHAMNEYPDSCAVLVRRHGVYVWGETWEKAKTMCECYDYLFDIAVSMKKVGLDPSQLPVGENGIV

SEQ ID NO: 5596 - protein, 195 aa, Homo sapiens
  Payload ID: 1228;
  Gene Symbol: APIP;
  Gene Name: APAF1 interacting prt;
  ENSP ID: ENSP00000474191
MFCVASDEIYIAPSGVQKERIQPEDMFVCDINEKDISGPSPSKKLKKSQCTPLFMNAYTMRGAGAVIHTHSKAAVMATLLFPGREFKITHQEMIKGIKKCTSGGYYRYDDMLVVPIIENTPEEKDLKDRMAHAMNEYPDSCAVLVRRHGVYVWGETWEKAKTMCECYDYLFDIAVSMKKVGLDPSQLPVGENGIV

SEQ ID NO: 5597 - protein, 1135 aa, Homo sapiens
  Payload ID: 1229;
  Gene Symbol: AMER1;
  Gene Name: APC membrane recruitment prt 1;
  Uniprot ID:  Q5JTC6;
  ENSP ID: ENSP00000329117
METQKDEAAQAKGAAASGSTREQTAEKGAKNKAAEATEGPTSEPSSSGPGRLKKTAMKLFGGKKGICTLPSFFGGGRSKGSGKGSSKKGLSKSKTHDGLSEAAHGPEDVVSEGTGFSLPLPELPCQFPSSQSAHGALETGSRCKTSVAGATEKAVAEKFPSMPKPKKGLKGFFSSIRRHRKSKVTGAEQSEPGAKGPERVRARPHEHVSSAPQVPCFEETFQAPRKENANPQDAPGPKVSPTPEPSPPATEKMACKDPEKPMEACASAHVQPKPAPEASSLEEPHSPETGEKVVAGEVNPPNGPVGDPLSLLFGDVTSLKSFDSLTGCGDIIAEQDMDSMTDSMASGGQRANRDGTKRSSCLVTYQGGGEEMALPDDDDEEEEEEEEVELEEEEEEVKEEEEDDDLEYLWETAQMYPRPNMNLGYHPTTSPGHHGYMLLDPVRSYPGLAPGELLTPQSDQQESAPNSDEGYYDSTTPGFEDDSGEALGLVRRDCLPRDSYSGDALYEFYEPDDSLENSPPGDDCLYDLHGRSSEMFDPFLNFEPFLSSRPPGAMETEEERLVTIQKQLLYWELRREQLEAQEARAREAHAREAHAREAYTREAYGREAYAREAHTWEAHGREARTREAQAREVRCRETQVRETQARQEKPVLEYQMRPLGPSVMGLAAGVSGTSQISHRGITSAFPTTASSEPDWRDFRPLEKRYEGTCSKKDQSTCLMQLFQSDAMFEPDMQEANFGGSPRRAYPTYSPPEDPEEEEVEKEGNATVSFSQALVEFTSNGNLFSSMSCSSDSDSSFTQNLPELPPMVTFDIADVERDGEGKCEENPEFHNDEDLAASLEAFELGYYHKHAFNNYHSRFYQGLPWGVSSLPRYLGLPGLHPRPPPAAMALNRRSRSLDTAETLEMELSNSHLVQGYLESDELQAQQEDSDEEDEEEEEGEWSRDSPLSLYTEPPGAYDWPAWAPCPLPVGPGPAWISPNQLDRPSSQSPYRQATCCIPPMTMSISLSVPESRAPGESGPQLARPSHLHLPMGPCYNLQPQASQSMRARPRDVLLPVDEPSCSSSSGGFSPSPLPQAKPVGITHGIPQLPRVRPEHPQPQPTHYGPSSLDLSKERAEQGASLATSYSSTAMNGNLAK

SEQ ID NO: 5598 - protein, 804 aa, Homo sapiens
  Payload ID: 1229;
  Gene Symbol: AMER1;
  Gene Name: APC membrane recruitment prt 1;
  Uniprot ID:  Q5JTC6;
  ENSP ID: ENSP00000364003
METQKDEAAQAKGAAASGSTREQTAEKGAKNKAAEATEGPTSEPSSSGPGRLKKTAMKLFGGKKGICTLPSFFGGGRSKGSGKGSSKKGLSKSKTHDGLSEAAHGPEDVVSEGTGFSLPLPELPCQFPSSQSAHGALETGSRCKTSVAGATEKAVAEKFPSMPKPKKGLKGFFSSIRRHRKSKVTGAEQSEPGAKGPERVRARPHEHVSSAPQVPCFEETFQAPRKENANPQDAPGPKVSPTPEPSPPATEKMACKDPEKPMEACASAHVQPKPAPEASSLEEPHSPETGEKVVAGEVNPPNGPVGDPLSLLFGDVTSLKSFDSLTGCGDIIAEQDMDSMTDSMASGGQRANRDGTKRSSCLVTYQGGGEEMALPDDDDEEEEEEEEVELEEEEEEVKEEEEDDDLEYLWETAQMYPRPNMNLGYHPTTSPGHHGYMLLDPVRSYPGLAPGELLTPQSDQQESAPNSDEGYYDSTTPGFEDDSGEALGLVRRDCLPRDSYSGDALYEFYEPDDSLENSPPGDDCLYDLHGRSSEMFDPFLNFEPFLSSRPPGAMETEEERLVTIQKQLLYWELRREQLEAQEARAREAHAREAHAREAYTREAYGREAYAREAHTWEAHGREARTREAQAREVRCRETQVRETQARQEKPVLEYQMRPLGPSVMGLAAGVSGTSQISHRGITSAFPTTASSEPDWRDFRPLEKRYEGTCSKKDQSTCLMQLFQSDAMFEPDMQEANFGGSPRRAYPTYSPPEDPEEEEVEKEGNATVSFSQALVEFTSNGNLFSSIRCPGTEDKRQVTQACGTW

SEQ ID NO: 5599 - protein, 552 aa, Homo sapiens
  Payload ID: 1230;
  Gene Symbol: AMER2;
  Gene Name: APC membrane recruitment prt 2;
  Uniprot ID:  Q8N7J2;
  ENSP ID: ENSP00000350469
METSRSRGGGGAVSERGGAGASVGVCRRKAEAGAGTGTLAADMDLHCDCAAETPAAEPPSGKINKAAFKLFKKRKSGGTMPSIFGVKNKGDGKSSGPTGLVRSRTHDGLAEVLVLESGRKEEPRGGGDSGGGGGGRPNPGPPRAAGPGGGSLASSSVAKSHSFFSLLKKNGRSENGKGEPVDASKAGGKQKRGLRGLFSGMRWHRKDKRAKAEAAEGRAPGGGLILPGSLTASLECVKEETPRAAREPEEPSQDAPRDPAGCGDIIADQEEEAGPSCDKHVPGPGKPALSKKNPGVVAYQGGGEEMASPDEVDDTYLQEFWDMLSQTEEQGPEPQEGAAKVAAALETKVVPETPKDTRCVEAAKDASSVKRRRLNRIPIEPHPKEEPKHPEKEQQEGVPNSDEGYWDSTTPGPEEDSSSSGKKAGIPRDSYSGDALYDLYADPDGSPATLPGGKDNEETSSLSRLKPVSPGTITCPLRTPGSLLKDSKIPISIKHLTNLPSSHPVVHQQPSRSEMPRTKIPVSKVLVRRVSNRGLAGTTIRATACHDSAKKL

SEQ ID NO: 5600 - protein, 671 aa, Homo sapiens
  Payload ID: 1230;
  Gene Symbol: AMER2;
  Gene Name: APC membrane recruitment prt 2;
  Uniprot ID:  Q8N7J2;
  ENSP ID: ENSP00000426528
METSRSRGGGGAVSERGGAGASVGVCRRKAEAGAGTGTLAADMDLHCDCAAETPAAEPPSGKINKAAFKLFKKRKSGGTMPSIFGVKNKGDGKSSGPTGLVRSRTHDGLAEVLVLESGRKEEPRGGGDSGGGGGGRPNPGPPRAAGPGGGSLASSSVAKSHSFFSLLKKNGRSENGKGEPVDASKAGGKQKRGLRGLFSGMRWHRKDKRAKAEAAEGRAPGGGLILPGSLTASLECVKEETPRAAREPEEPSQDAPRDPAGEPAGGEEVPAPADRAPARSCREAEGLAHPGDTGARGEDAAGHRRAEPGPGEVRTAEDASRTGAVPVKTVPLVDSEGGSGRAPAAPDPASVDPPSDPSADRICLMFSDVTSLKSFDSLTGCGDIIADQEEEAGPSCDKHVPGPGKPALSKKNPGVVAYQGGGEEMASPDEVDDTYLQEFWDMLSQTEEQGPEPQEGAAKVAAALETKVVPETPKDTRCVEAAKDASSVKRRRLNRIPIEPHPKEEPKHPEKEQQEGVPNSDEGYWDSTTPGPEEDSSSSGKKAGIPRDSYSGDALYDLYADPDGSPATLPGGKDNEETSSLSRLKPVSPGTITCPLRTPGSLLKDSKIPISIKHLTNLPSSHPVVHQQPSRSEMPRTKIPVSKVLVRRVSNRGLAGTTIRATACHDSAKKL

SEQ ID NO: 5601 - protein, 861 aa, Homo sapiens
  Payload ID: 1231;
  Gene Symbol: AMER3;
  Gene Name: APC membrane recruitment prt 3;
  Uniprot ID:  Q8N944;
  ENSP ID: ENSP00000314914
MELKRGKTFIKSSLQVSHEKPPDPAAVAAAREGTGPWSVLPGGQQRPHSEKGPQASPSAQEYDRCPNKGAQLDPKGGPAALCGATFKPVRKCKTHDSMSGAGRATAATGQLVGSASFPGSPGSRRMIDYRHFVPQMPFVPAVAKSIPRKRISLKRPKKCFRNLFHIRRNKTEDLASLAAEGKSLPSPGDPSDPGGRRSKAFLPPGEGPGLDGLCQDLLDSELLADASFGLCRALCEDVASLQSFDSLTGCGEVFADESSVPSLELNEGPESPTQAAQGLESKVPRGPLQGSVEQLASPAQNEASDFTRFWDSVNRSVRQQQRALLGPWLSGPQGTDRDQSRLDTAGLAELPLCPCRDPRSGSKASSIDTGTPKSEQPESVSTSDEGYYDSFSPGLEEDKKEAESPGTPAATFPRDSYSGDALYELFHDPSEGPLGPSPDDDLCVSESLSGPALGTPLSICSFRVGAEENLAPAPGPDLLSQGFLQSSWKGKECLLKLCDTELAITMGIVSWLRRGPTPRAPPTPGQPAAPPGSQGAPRAPTEKLGGREGLASDAGGATVCSAPSRQELWAHPGTTGLLAGESKALGGATQGTGTLSRDASREEETRGHSEGLFSSMESAATSTTDTSGKNKAPVPSTWPCSQKEPGPPGVLGCFRGPWRPGHGGDTLDAEPMLAGCVARVAALKISSNEQPPAAWPPRQDMGSGLFGQRWARGPDMLEQKQSSSSPSMTTIHGLPYSASTQDQRCRDRVQDLSWLRVEPTGLGVQAWASVEDQPLQLSTEAVEQVAHGSQLDSEPRSAPAARWSSQGHHPESLGLTLNSQQEGGVSASAPECRCSLLAREGLLCGQPEVGASGPAMAEPHL

SEQ ID NO: 5602 - protein, 180 aa, Homo sapiens
  Payload ID: 1231;
  Gene Symbol: AMER3;
  Gene Name: APC membrane recruitment prt 3;
  ENSP ID: ENSP00000389242
MELKRGKTFIKSSLQVSHEKPPDPAAVAAAREGTGPWSVLPGGQQRPHSEKGPQASPSAQEYDRCPNKGAQLDPKGGPAALCGATFKPVRKCKTHDSMSGAGRATAATGQLVGSASFPGSPGSRRMIDYRHFVPQMPFVPAVAKSIPRKRISLKRPKKCFRNLFHIRRNKTEDLASLAAE

SEQ ID NO: 5603 - protein, 861 aa, Homo sapiens; identical to SEQ ID NO: 5601
  Payload ID: 1231;
  Gene Symbol: AMER3;
  Gene Name: APC membrane recruitment prt 3;
  Uniprot ID:  Q8N944;
  ENSP ID: ENSP00000392700

SEQ ID NO: 5604 - protein, 141 aa, Homo sapiens
  Payload ID: 1231;
  Gene Symbol: AMER3;
  Gene Name: APC membrane recruitment prt 3;
  ENSP ID: ENSP00000410421
MELKRGKTFIKSSLQVSHEKPPDPAAVAAAREGTGPWSVLPGGQQRPHSEKGPQASPSAQEYDRCPNKGAQLDPKGGPAALCGATFKPVRKCKTHDSMSGAGRATAATGQLVGSASFPGSPGSRRMIDYRHFVPQMPFVPA

SEQ ID NO: 5605 - protein, 77 aa, Homo sapiens
  Payload ID: 1232;
  Gene Symbol: APLN;
  Gene Name: apelin;
  Uniprot ID:  Q9ULZ1;
  ENSP ID: ENSP00000391800
MNLRLCVQALLLLWLSLTAVCGGSLMPLPDGNGLEDGNVRHLVQPRGSRNGPGPWQGGRRKFRRQRPRLSHKGPMPF

SEQ ID NO: 5606 - protein, 380 aa, Homo sapiens
  Payload ID: 1233;
  Gene Symbol: APLNR;
  Gene Name: apelin receptor;
  Uniprot ID:  P35414;
  ENSP ID: ENSP00000257254
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 5607 - protein, 380 aa, Homo sapiens; identical to SEQ ID NO: 5606
  Payload ID: 1233;
  Gene Symbol: APLNR;
  Gene Name: apelin receptor;
  Uniprot ID:  P35414;
  ENSP ID: ENSP00000475344

SEQ ID NO: 5608 - protein, 380 aa, Homo sapiens; identical to SEQ ID NO: 5606
  Payload ID: 1233;
  Gene Symbol: APLNR;
  Gene Name: apelin receptor;
  Uniprot ID:  P35414;
  ENSP ID: ENSP00000477818

SEQ ID NO: 5609 - protein, 54 aa, Homo sapiens
  Payload ID: 1234;
  Gene Symbol: APELA;
  Gene Name: apelin receptor early endogenous ligand;
  Uniprot ID:  P0DMC3;
  ENSP ID: ENSP00000478306
MRFQQFLFAFFIFIMSLLLISGQRPVNLTMRRKLRKHNCLQRRCMPLHSRVPFP

SEQ ID NO: 5610 - protein, 54 aa, Homo sapiens; identical to SEQ ID NO: 5609
  Payload ID: 1234;
  Gene Symbol: APELA;
  Gene Name: apelin receptor early endogenous ligand;
  Uniprot ID:  P0DMC3;
  ENSP ID: ENSP00000480045

SEQ ID NO: 5611 - protein, 54 aa, Homo sapiens; identical to SEQ ID NO: 5609
  Payload ID: 1234;
  Gene Symbol: APELA;
  Gene Name: apelin receptor early endogenous ligand;
  Uniprot ID:  P0DMC3;
  ENSP ID: ENSP00000484618

SEQ ID NO: 5612 - protein, 518 aa, Homo sapiens
  Payload ID: 1235;
  Gene Symbol: APEX2;
  Gene Name: APEX nuclease (apurinic/apyrimidinic endonuclease) 2;
  Uniprot ID:  Q9UBZ4;
  ENSP ID: ENSP00000364126
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 5613 - protein, 318 aa, Homo sapiens
  Payload ID: 1236;
  Gene Symbol: APEX1;
  Gene Name: APEX nuclease (multifunctional DNA repair enzyme) 1;
  Uniprot ID:  P27695;
  ENSP ID: ENSP00000216714
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 5614 - protein, 318 aa, Homo sapiens; identical to SEQ ID NO: 5613
  Payload ID: 1236;
  Gene Symbol: APEX1;
  Gene Name: APEX nuclease (multifunctional DNA repair enzyme) 1;
  Uniprot ID:  P27695;
  ENSP ID: ENSP00000381111

SEQ ID NO: 5615 - protein, 150 aa, Homo sapiens
  Payload ID: 1236;
  Gene Symbol: APEX1;
  Gene Name: APEX nuclease (multifunctional DNA repair enzyme) 1;
  ENSP ID: ENSP00000416414
  MOD_RES (1)..(1): Any amino acid
XKTSPSGKPATLKICSWNVDGLRAWIKKKGLDWVKEEAPDILCLQETKCSENKLPAELQELPGLSHQYWSAPSDKEGYSGVGLLSRQCPLKVSYGIAYVPNAGRGLVRLEYRQRWDEAFRKFLKGLASRKPLVLCGDLNVAHEEIDLRNP

SEQ ID NO: 5616 - protein, 49 aa, Homo sapiens
  Payload ID: 1236;
  Gene Symbol: APEX1;
  Gene Name: APEX nuclease (multifunctional DNA repair enzyme) 1;
  ENSP ID: ENSP00000450604
MPKRGKKGAVAEDGDELRTGKGMKSALLPRSCGGGVCHSLDVRARGQEE

SEQ ID NO: 5617 - protein, 172 aa, Homo sapiens
  Payload ID: 1236;
  Gene Symbol: APEX1;
  Gene Name: APEX nuclease (multifunctional DNA repair enzyme) 1;
  ENSP ID: ENSP00000451060
MYEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWD

SEQ ID NO: 5618 - protein, 174 aa, Homo sapiens
  Payload ID: 1236;
  Gene Symbol: APEX1;
  Gene Name: APEX nuclease (multifunctional DNA repair enzyme) 1;
  ENSP ID: ENSP00000451170
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPN

SEQ ID NO: 5619 - protein, 263 aa, Homo sapiens
  Payload ID: 1236;
  Gene Symbol: APEX1;
  Gene Name: APEX nuclease (multifunctional DNA repair enzyme) 1;
  ENSP ID: ENSP00000451327
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYA

SEQ ID NO: 5620 - protein, 41 aa, Homo sapiens
  Payload ID: 1236;
  Gene Symbol: APEX1;
  Gene Name: APEX nuclease (multifunctional DNA repair enzyme) 1;
  ENSP ID: ENSP00000451491
MYEPEAKKSKTAAKKNDKEAAGEGPALYEDPPDQKTSPSGK

SEQ ID NO: 5621 - protein, 318 aa, Homo sapiens; identical to SEQ ID NO: 5613
  Payload ID: 1236;
  Gene Symbol: APEX1;
  Gene Name: APEX nuclease (multifunctional DNA repair enzyme) 1;
  Uniprot ID:  P27695;
  ENSP ID: ENSP00000451979

SEQ ID NO: 5622 - protein, 146 aa, Homo sapiens
  Payload ID: 1236;
  Gene Symbol: APEX1;
  Gene Name: APEX nuclease (multifunctional DNA repair enzyme) 1;
  ENSP ID: ENSP00000452137
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGI

SEQ ID NO: 5623 - protein, 14 aa, Homo sapiens
  Payload ID: 1236;
  Gene Symbol: APEX1;
  Gene Name: APEX nuclease (multifunctional DNA repair enzyme) 1;
  ENSP ID: ENSP00000452212
MPKRGKKGAPFASS

SEQ ID NO: 5624 - protein, 107 aa, Homo sapiens
  Payload ID: 1236;
  Gene Symbol: APEX1;
  Gene Name: APEX nuclease (multifunctional DNA repair enzyme) 1;
  ENSP ID: ENSP00000452304
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAE

SEQ ID NO: 5625 - protein, 162 aa, Homo sapiens
  Payload ID: 1236;
  Gene Symbol: APEX1;
  Gene Name: APEX nuclease (multifunctional DNA repair enzyme) 1;
  ENSP ID: ENSP00000452418
MYEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGL

SEQ ID NO: 5626 - protein, 242 aa, Homo sapiens
  Payload ID: 1236;
  Gene Symbol: APEX1;
  Gene Name: APEX nuclease (multifunctional DNA repair enzyme) 1;
  ENSP ID: ENSP00000452460
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMM

SEQ ID NO: 5627 - protein, 150 aa, Homo sapiens
  Payload ID: 1237;
  Gene Symbol: APH1A;
  Gene Name: APH1A gamma secretase subunit;
  ENSP ID: ENSP00000236017
MGAAVFFGCTFVAFGPAFALFLITVAGDPLRVIILVAGKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLN

SEQ ID NO: 5628 - protein, 247 aa, Homo sapiens
  Payload ID: 1237;
  Gene Symbol: APH1A;
  Gene Name: APH1A gamma secretase subunit;
  Uniprot ID:  Q96BI3;
  ENSP ID: ENSP00000353380
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCKD

SEQ ID NO: 5629 - protein, 265 aa, Homo sapiens
  Payload ID: 1237;
  Gene Symbol: APH1A;
  Gene Name: APH1A gamma secretase subunit;
  Uniprot ID:  Q96BI3;
  ENSP ID: ENSP00000358105
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCRRQEDSRVMVYSALRIPPED

SEQ ID NO: 5630 - protein, 195 aa, Homo sapiens
  Payload ID: 1237;
  Gene Symbol: APH1A;
  Gene Name: APH1A gamma secretase subunit;
  Uniprot ID:  Q96BI3;
  ENSP ID: ENSP00000397473
MGAAVFFGCTFVAFGPAFALFLITVAGDPLRVIILVAGRCSALPTTSCLISGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCRRQEDSRVMVYSALRIPPED

SEQ ID NO: 5631 - protein, 257 aa, Homo sapiens
  Payload ID: 1238;
  Gene Symbol: APH1B;
  Gene Name: APH1B gamma secretase subunit;
  Uniprot ID:  Q8WW43;
  ENSP ID: ENSP00000261879
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 5632 - protein, 81 aa, Homo sapiens
  Payload ID: 1238;
  Gene Symbol: APH1B;
  Gene Name: APH1B gamma secretase subunit;
  ENSP ID: ENSP00000369697
MTAAVFFGCAFIAFGPALALYVFTIATEPLRIIFLIAGRRVETCKNTEAPDCASPSGSLSFLLVGVSTDFVPCLVHGKSHY

SEQ ID NO: 5633 - protein, 216 aa, Homo sapiens
  Payload ID: 1238;
  Gene Symbol: APH1B;
  Gene Name: APH1B gamma secretase subunit;
  Uniprot ID:  Q8WW43;
  ENSP ID: ENSP00000369700
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 5634 - protein, 188 aa, Homo sapiens
  Payload ID: 1238;
  Gene Symbol: APH1B;
  Gene Name: APH1B gamma secretase subunit;
  ENSP ID: ENSP00000453002
MARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCL

SEQ ID NO: 5635 - protein, 222 aa, Homo sapiens
  Payload ID: 1238;
  Gene Symbol: APH1B;
  Gene Name: APH1B gamma secretase subunit;
  ENSP ID: ENSP00000453327
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSDLHKFLLWNKPGVSIYNPGAHGHLGILSCGRQLPKPETLPALPRQELSSLQPALQITSGNQHF

SEQ ID NO: 5636 - protein, 19 aa, Homo sapiens
  Payload ID: 1238;
  Gene Symbol: APH1B;
  Gene Name: APH1B gamma secretase subunit;
  ENSP ID: ENSP00000453516
LYVFTIATEPLRIIFLIAG

SEQ ID NO: 5637 - protein, 164 aa, Homo sapiens
  Payload ID: 1239;
  Gene Symbol: APITD1-CORT;
  Gene Name: APITD1-CORT readthrough;
  ENSP ID: ENSP00000383692
MEEEAETEEQQRFSYQQRLKAAVHYTVGCLCEEVALDKEMQFSKQTIAAISELTFRQCENFAKDLEMFARHAKRTTINTEDVKLLARRSNSLHMQEAAGIRKSSLLTFLAWWFEWTSQASAGPLIGEEAREVARRQEGAPPQQSARRDRMPCRNFFWKTFSSCK

SEQ ID NO: 5638 - protein, 77 aa, Homo sapiens
  Payload ID: 1239;
  Gene Symbol: APITD1-CORT;
  Gene Name: APITD1-CORT readthrough;
  ENSP ID: ENSP00000433615
MEEEAETEEQQRFSYQQRLKAAVHYTVGCLCEEVALDKEMQFSKQTIAAISELTFRQCENFAKDLEMFASICRKRQE

SEQ ID NO: 5639 - protein, 143 aa, Homo sapiens
  Payload ID: 1239;
  Gene Symbol: APITD1-CORT;
  Gene Name: APITD1-CORT readthrough;
  ENSP ID: ENSP00000473401
MSSRRGSFLSTKLHCSSCLPCPLSFEKFKPSEKLQEHENFAKDLEMFARHAKRTTINTEDVKLLARRSNSLHMQEAAGIRKSSLLTFLAWWFEWTSQASAGPLIGEEAREVARRQEGAPPQQSARRDRMPCRNFFWKTFSSCK

SEQ ID NO: 5640 - protein, 138 aa, Homo sapiens
  Payload ID: 1239;
  Gene Symbol: APITD1-CORT;
  Gene Name: APITD1-CORT readthrough;
  ENSP ID: ENSP00000473509
MEEEAETEEQQRFSYQQRLKAAVHYTVGCLCEEVALDKEMQFSKQTIAAISELTFRQCENFAKDLEMFARHAKRTTINTEDVKLLARRSNSLLKYITDKSEEIAQINLERKAQKKKKSEDGSKNSRQPAEAGVVESEN

SEQ ID NO: 5641 - protein, 49 aa, Homo sapiens
  Payload ID: 1239;
  Gene Symbol: APITD1-CORT;
  Gene Name: APITD1-CORT readthrough;
  ENSP ID: ENSP00000489060
MSSRRGSFLSTKLHCSSCLPCPLSFEKFKPSEKLQEHDMRKEPQLTLKM

SEQ ID NO: 5642 - protein, 586 aa, Homo sapiens
  Payload ID: 1240;
  Gene Symbol: A1CF;
  Gene Name: APOBEC1 complementation factor;
  Uniprot ID:  Q9NQ94;
  ENSP ID: ENSP00000282641
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 5643 - protein, 594 aa, Homo sapiens
  Payload ID: 1240;
  Gene Symbol: A1CF;
  Gene Name: APOBEC1 complementation factor;
  Uniprot ID:  Q9NQ94;
  ENSP ID: ENSP00000363105
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVREIYMNVPVGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 5644 - protein, 594 aa, Homo sapiens
  Payload ID: 1240;
  Gene Symbol: A1CF;
  Gene Name: APOBEC1 complementation factor;
  Uniprot ID:  Q9NQ94;
  ENSP ID: ENSP00000363107
MEAVCLGTCPEPEASMSTAIPGLKKGNNALQSIILQTLLEKENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 5645 - protein, 586 aa, Homo sapiens; identical to SEQ ID NO: 5642
  Payload ID: 1240;
  Gene Symbol: A1CF;
  Gene Name: APOBEC1 complementation factor;
  Uniprot ID:  Q9NQ94;
  ENSP ID: ENSP00000363109

SEQ ID NO: 5646 - protein, 586 aa, Homo sapiens; identical to SEQ ID NO: 5642
  Payload ID: 1240;
  Gene Symbol: A1CF;
  Gene Name: APOBEC1 complementation factor;
  Uniprot ID:  Q9NQ94;
  ENSP ID: ENSP00000363113

SEQ ID NO: 5647 - protein, 602 aa, Homo sapiens
  Payload ID: 1240;
  Gene Symbol: A1CF;
  Gene Name: APOBEC1 complementation factor;
  ENSP ID: ENSP00000378868
MEAVCLGTCPEPEASMSTAIPGLKKGNNALQSIILQTLLEKENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVREIYMNVPVGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 5648 - protein, 594 aa, Homo sapiens; identical to SEQ ID NO: 5644
  Payload ID: 1240;
  Gene Symbol: A1CF;
  Gene Name: APOBEC1 complementation factor;
  Uniprot ID:  Q9NQ94;
  ENSP ID: ENSP00000378873

SEQ ID NO: 5649 - protein, 201 aa, Homo sapiens
  Payload ID: 1240;
  Gene Symbol: A1CF;
  Gene Name: APOBEC1 complementation factor;
  ENSP ID: ENSP00000397953
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLP

SEQ ID NO: 5650 - protein, 101 aa, Homo sapiens
  Payload ID: 1241;
  Gene Symbol: APOC4-APOC2;
  Gene Name: APOC4-APOC2 readthrough (NMD candidate);
  ENSP ID: ENSP00000252490
MGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 5651 - protein, 127 aa, Homo sapiens
  Payload ID: 1241;
  Gene Symbol: APOC4-APOC2;
  Gene Name: APOC4-APOC2 readthrough (NMD candidate);
  ENSP ID: ENSP00000467185
MSLLRNRLQALPALCLCVLVLACIGACQPEAQEGTLSPPPKLKMSRWSLVRGRMKELLETVVNRTRDGWQWFWSPSTFRGFMQTYYDDHLRDLGPLTKAWFLESKDSLLKKTHSLCPRLVCGDKDQG

SEQ ID NO: 5652 - protein, 178 aa, Homo sapiens
  Payload ID: 1241;
  Gene Symbol: APOC4-APOC2;
  Gene Name: APOC4-APOC2 readthrough (NMD candidate);
  ENSP ID: ENSP00000468139
MSLLRNRLQALPALCLCVLVLACIGACQPEAQEGTLSPPPKLKMSRWSLVRGRMKELLETVVNRTRDGWQWFWSLDTMGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 5653 - protein, 267 aa, Homo sapiens
  Payload ID: 1242;
  Gene Symbol: APOA1;
  Gene Name: apolipoprt A-I;
  Uniprot ID:  P02647;
  ENSP ID: ENSP00000236850
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 5654 - protein, 267 aa, Homo sapiens; identical to SEQ ID NO: 5653
  Payload ID: 1242;
  Gene Symbol: APOA1;
  Gene Name: apolipoprt A-I;
  Uniprot ID:  P02647;
  ENSP ID: ENSP00000352471

SEQ ID NO: 5655 - protein, 267 aa, Homo sapiens; identical to SEQ ID NO: 5653
  Payload ID: 1242;
  Gene Symbol: APOA1;
  Gene Name: apolipoprt A-I;
  Uniprot ID:  P02647;
  ENSP ID: ENSP00000364469

SEQ ID NO: 5656 - protein, 267 aa, Homo sapiens; identical to SEQ ID NO: 5653
  Payload ID: 1242;
  Gene Symbol: APOA1;
  Gene Name: apolipoprt A-I;
  Uniprot ID:  P02647;
  ENSP ID: ENSP00000364472

SEQ ID NO: 5657 - protein, 245 aa, Homo sapiens
  Payload ID: 1242;
  Gene Symbol: APOA1;
  Gene Name: apolipoprt A-I;
  ENSP ID: ENSP00000364478
MSGGARGFCMLKAPHSARPFFSSRSPTALQDESCGADLGRALPDGLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 5658 - protein, 245 aa, Homo sapiens
  Payload ID: 1243;
  Gene Symbol: APOA1BP;
  Gene Name: apolipoprt A-I binding prt;
  ENSP ID: ENSP00000357216
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGAGIQKVGWGRLGPYPPDSCPHQV

SEQ ID NO: 5659 - protein, 260 aa, Homo sapiens
  Payload ID: 1243;
  Gene Symbol: APOA1BP;
  Gene Name: apolipoprt A-I binding prt;
  ENSP ID: ENSP00000357217
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAELQGRCSGTVPQHPECPEGTHCAHCQHRHSLRMGRGEGKCWRDPARLAHIPHSPQKICNPVYRSLPLPGGSFCATCSGEEVPAEPATLP

SEQ ID NO: 5660 - protein, 288 aa, Homo sapiens
  Payload ID: 1243;
  Gene Symbol: APOA1BP;
  Gene Name: apolipoprt A-I binding prt;
  Uniprot ID:  Q8NCW5;
  ENSP ID: ENSP00000357218
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 5661 - protein, 100 aa, Homo sapiens
  Payload ID: 1244;
  Gene Symbol: APOA2;
  Gene Name: apolipoprt A-II;
  Uniprot ID:  P02652;
  ENSP ID: ENSP00000356969
MKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 5662 - protein, 66 aa, Homo sapiens
  Payload ID: 1244;
  Gene Symbol: APOA2;
  Gene Name: apolipoprt A-II;
  ENSP ID: ENSP00000476605
MKLLAATVLLLTICSLEGALVRRQAKEPCVESLVSQYFQTVTDYGKDLMEKVKSPELQAEAKSYFE

SEQ ID NO: 5663 - protein, 52 aa, Homo sapiens
  Payload ID: 1244;
  Gene Symbol: APOA2;
  Gene Name: apolipoprt A-II;
  ENSP ID: ENSP00000476662
MEKVKSPELQAEAKSYFEKSKEQLTPLIKKAGTELVNFLSYFVELGTQPATQ

SEQ ID NO: 5664 - protein, 95 aa, Homo sapiens
  Payload ID: 1244;
  Gene Symbol: APOA2;
  Gene Name: apolipoprt A-II;
  ENSP ID: ENSP00000476740
MKLLAATVLLLTICSLEGALVRRQAKEPCVESLVSQYFQTVTDYGKDLMEKVKSPELQAEAKSYFEKSKEQLTPLIKKAGTELVNFLSYFVELGT

SEQ ID NO: 5665 - protein, 52 aa, Homo sapiens; identical to SEQ ID NO: 5663
  Payload ID: 1244;
  Gene Symbol: APOA2;
  Gene Name: apolipoprt A-II;
  ENSP ID: ENSP00000476890

SEQ ID NO: 5666 - protein, 133 aa, Homo sapiens
  Payload ID: 1244;
  Gene Symbol: APOA2;
  Gene Name: apolipoprt A-II;
  ENSP ID: ENSP00000476911
MCEQHPKRPGLQLWRGREPGWNGQQAALPTVTNMKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 5667 - protein, 82 aa, Homo sapiens
  Payload ID: 1244;
  Gene Symbol: APOA2;
  Gene Name: apolipoprt A-II;
  ENSP ID: ENSP00000477031
MKLLAATVLLLTICSLEGALVRRQAKEPCVESLVSQYFQTVTDYGKDLMEKVKSPELQAEAKSYFENFLSYFVELGTQPATQ

SEQ ID NO: 5668 - protein, 72 aa, Homo sapiens
  Payload ID: 1244;
  Gene Symbol: APOA2;
  Gene Name: apolipoprt A-II;
  ENSP ID: ENSP00000477054
MKLLAATVLLLTICSLEGLATKGLKRKIIPSLKPRKPIQRSGWIPFWGGGRELGWVLAEVWQEARIHCCGPS

SEQ ID NO: 5669 - protein, 27 aa, Homo sapiens
  Payload ID: 1244;
  Gene Symbol: APOA2;
  Gene Name: apolipoprt A-II;
  ENSP ID: ENSP00000477353
MKLLAATVLLLTICSLEGLTLKSQRSS

SEQ ID NO: 5670 - protein, 396 aa, Homo sapiens
  Payload ID: 1245;
  Gene Symbol: APOA4;
  Gene Name: apolipoprt A-IV;
  Uniprot ID:  P06727;
  ENSP ID: ENSP00000350425
MFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVSTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRQKLGPHAGDVEGHLSFLEKDLRDKVNSFFSTFKEKESQDKTLSLPELEQQQEQQQEQQQEQVQMLAPLES

SEQ ID NO: 5671 - protein, 366 aa, Homo sapiens
  Payload ID: 1246;
  Gene Symbol: APOA5;
  Gene Name: apolipoprt A-V;
  Uniprot ID:  Q6Q788;
  ENSP ID: ENSP00000227665
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 5672 - protein, 162 aa, Homo sapiens
  Payload ID: 1246;
  Gene Symbol: APOA5;
  Gene Name: apolipoprt A-V;
  ENSP ID: ENSP00000399701
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQL

SEQ ID NO: 5673 - protein, 366 aa, Homo sapiens; identical to SEQ ID NO: 5671
  Payload ID: 1246;
  Gene Symbol: APOA5;
  Gene Name: apolipoprt A-V;
  Uniprot ID:  Q6Q788;
  ENSP ID: ENSP00000445002

SEQ ID NO: 5674 - protein, 4563 aa, Homo sapiens
  Payload ID: 1247;
  Gene Symbol: APOB;
  Gene Name: apolipoprt B;
  Uniprot ID:  P04114;
  ENSP ID: ENSP00000233242
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDILEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 5675 - protein, 828 aa, Homo sapiens
  Payload ID: 1247;
  Gene Symbol: APOB;
  Gene Name: apolipoprt B;
  ENSP ID: ENSP00000382200
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMDRPDSLTIPAAQARKDACTFFRDGGLP

SEQ ID NO: 5676 - protein, 4344 aa, Homo sapiens
  Payload ID: 1247;
  Gene Symbol: APOB;
  Gene Name: apolipoprt B;
  ENSP ID: ENSP00000477990
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDILEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPCF

SEQ ID NO: 5677 - protein, 236 aa, Homo sapiens
  Payload ID: 1248;
  Gene Symbol: APOBEC1;
  Gene Name: apolipoprt B mRNA editing enzyme, catalytic polypeptide 1;
  Uniprot ID:  P41238;
  ENSP ID: ENSP00000229304
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 5678 - protein, 36 aa, Homo sapiens
  Payload ID: 1248;
  Gene Symbol: APOBEC1;
  Gene Name: apolipoprt B mRNA editing enzyme, catalytic polypeptide 1;
  ENSP ID: ENSP00000436415
MTSEKGEESNPGSLTSSMTPENFVKRPVCSTKSSGA

SEQ ID NO: 5679 - protein, 224 aa, Homo sapiens
  Payload ID: 1249;
  Gene Symbol: APOBEC2;
  Gene Name: apolipoprt B mRNA editing enzyme, catalytic polypeptide-like 2;
  Uniprot ID:  Q9Y235;
  ENSP ID: ENSP00000244669
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 5680 - protein, 199 aa, Homo sapiens
  Payload ID: 1250;
  Gene Symbol: APOBEC3A;
  Gene Name: apolipoprt B mRNA editing enzyme, catalytic polypeptide-like 3A;
  Uniprot ID:  P31941;
  ENSP ID: ENSP00000249116
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 5681 - protein, 199 aa, Homo sapiens; identical to SEQ ID NO: 5680
  Payload ID: 1250;
  Gene Symbol: APOBEC3A;
  Gene Name: apolipoprt B mRNA editing enzyme, catalytic polypeptide-like 3A;
  Uniprot ID:  P31941;
  ENSP ID: ENSP00000384359

SEQ ID NO: 5682 - protein, 199 aa, Homo sapiens; identical to SEQ ID NO: 5680
  Payload ID: 1250;
  Gene Symbol: APOBEC3A;
  Gene Name: apolipoprt B mRNA editing enzyme, catalytic polypeptide-like 3A;
  Uniprot ID:  P31941;
  ENSP ID: ENSP00000461288

SEQ ID NO: 5683 - protein, 199 aa, Homo sapiens; identical to SEQ ID NO: 5680
  Payload ID: 1250;
  Gene Symbol: APOBEC3A;
  Gene Name: apolipoprt B mRNA editing enzyme, catalytic polypeptide-like 3A;
  Uniprot ID:  P31941;
  ENSP ID: ENSP00000481904

SEQ ID NO: 5684 - protein, 199 aa, Homo sapiens; identical to SEQ ID NO: 5680
  Payload ID: 1250;
  Gene Symbol: APOBEC3A;
  Gene Name: apolipoprt B mRNA editing enzyme, catalytic polypeptide-like 3A;
  Uniprot ID:  P31941;
  ENSP ID: ENSP00000485234

SEQ ID NO: 5685 - protein, 382 aa, Homo sapiens
  Payload ID: 1251;
  Gene Symbol: APOBEC3B;
  Gene Name: apolipoprt B mRNA editing enzyme, catalytic polypeptide-like 3B;
  Uniprot ID:  Q9UH17;
  ENSP ID: ENSP00000327459
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 5686 - protein, 251 aa, Homo sapiens
  Payload ID: 1251;
  Gene Symbol: APOBEC3B;
  Gene Name: apolipoprt B mRNA editing enzyme, catalytic polypeptide-like 3B;
  Uniprot ID:  Q9UH17;
  ENSP ID: ENSP00000338897
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRLRIFSVAFTAAMRSCASWTWFLLCSWTRPRSTGSLGSSPGAPASPGAVPGKCVRSFRRTHT

SEQ ID NO: 5687 - protein, 490 aa, Homo sapiens
  Payload ID: 1251;
  Gene Symbol: APOBEC3B;
  Gene Name: apolipoprt B mRNA editing enzyme, catalytic polypeptide-like 3B;
  ENSP ID: ENSP00000385060
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQVRASSLCLVPHRPPPPPRSPVPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 5688 - protein, 357 aa, Homo sapiens
  Payload ID: 1251;
  Gene Symbol: APOBEC3B;
  Gene Name: apolipoprt B mRNA editing enzyme, catalytic polypeptide-like 3B;
  Uniprot ID:  Q9UH17;
  ENSP ID: ENSP00000385068
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNELDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 5689 - protein, 190 aa, Homo sapiens
  Payload ID: 1252;
  Gene Symbol: APOBEC3C;
  Gene Name: apolipoprt B mRNA editing enzyme, catalytic polypeptide-like 3C;
  Uniprot ID:  Q9NRW3;
  ENSP ID: ENSP00000355340
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 5690 - protein, 61 aa, Homo sapiens
  Payload ID: 1252;
  Gene Symbol: APOBEC3C;
  Gene Name: apolipoprt B mRNA editing enzyme, catalytic polypeptide-like 3C;
  ENSP ID: ENSP00000390855
MNPQIRWILRPIVMQKGASSLGSATTYCLLTQSTRSPGTHLGALAQTVQGRWPSSWPGTAT

SEQ ID NO: 5691 - protein, 386 aa, Homo sapiens
  Payload ID: 1253;
  Gene Symbol: APOBEC3D;
  Gene Name: apolipoprt B mRNA editing enzyme, catalytic polypeptide-like 3D;
  Uniprot ID:  Q96AK3;
  ENSP ID: ENSP00000216099
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 5692 - protein, 386 aa, Homo sapiens; identical to SEQ ID NO: 5691
  Payload ID: 1253;
  Gene Symbol: APOBEC3D;
  Gene Name: apolipoprt B mRNA editing enzyme, catalytic polypeptide-like 3D;
  Uniprot ID:  Q96AK3;
  ENSP ID: ENSP00000370980

SEQ ID NO: 5693 - protein, 202 aa, Homo sapiens
  Payload ID: 1253;
  Gene Symbol: APOBEC3D;
  Gene Name: apolipoprt B mRNA editing enzyme, catalytic polypeptide-like 3D;
  ENSP ID: ENSP00000388017
MNPQIRNPMERMYRDTFYDNFENEPILYGRSYTWLCYEVKIKRGRSNLLWDTGVFRGPVLPKRQSNHRQEVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 5694 - protein, 190 aa, Homo sapiens
  Payload ID: 1253;
  Gene Symbol: APOBEC3D;
  Gene Name: apolipoprt B mRNA editing enzyme, catalytic polypeptide-like 3D;
  ENSP ID: ENSP00000480718
MNPQIRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 5695 - protein, 373 aa, Homo sapiens
  Payload ID: 1254;
  Gene Symbol: APOBEC3F;
  Gene Name: apolipoprt B mRNA editing enzyme, catalytic polypeptide-like 3F;
  Uniprot ID:  Q8IUX4;
  ENSP ID: ENSP00000309749
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 5696 - protein, 101 aa, Homo sapiens
  Payload ID: 1254;
  Gene Symbol: APOBEC3F;
  Gene Name: apolipoprt B mRNA editing enzyme, catalytic polypeptide-like 3F;
  Uniprot ID:  Q8IUX4;
  ENSP ID: ENSP00000370977
MKPHFRNTVERMYRDTFSYNFYNRPILSRRNTVWLCYEVKTKGPSRPRLDAKIFRGQVPRSFIRAPFQVLSSPFGQCAPPHGTAQVQWPPQLTAGREQGRP

SEQ ID NO: 5697 - protein, 384 aa, Homo sapiens
  Payload ID: 1255;
  Gene Symbol: APOBEC3G;
  Gene Name: apolipoprt B mRNA editing enzyme, catalytic polypeptide-like 3G;
  Uniprot ID:  Q9HC16;
  ENSP ID: ENSP00000385057
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 5698 - protein, 384 aa, Homo sapiens; identical to SEQ ID NO: 5697
  Payload ID: 1255;
  Gene Symbol: APOBEC3G;
  Gene Name: apolipoprt B mRNA editing enzyme, catalytic polypeptide-like 3G;
  Uniprot ID:  Q9HC16;
  ENSP ID: ENSP00000413376

SEQ ID NO: 5699 - protein, 182 aa, Homo sapiens
  Payload ID: 1256;
  Gene Symbol: APOBEC3H;
  Gene Name: apolipoprt B mRNA editing enzyme, catalytic polypeptide-like 3H;
  Uniprot ID:  Q6NTF7;
  ENSP ID: ENSP00000216123
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPEFADCWENFVDHEKPLSFNPYKMLEELDKNSRAIKRRLERIKS

SEQ ID NO: 5700 - protein, 200 aa, Homo sapiens
  Payload ID: 1256;
  Gene Symbol: APOBEC3H;
  Gene Name: apolipoprt B mRNA editing enzyme, catalytic polypeptide-like 3H;
  Uniprot ID:  Q6NTF7;
  ENSP ID: ENSP00000385741
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPEFADCWENFVDHEKPLSFNPYKMLEELDKNSRAIKRRLERIKIPGVRAQGRYMDILCDAEV

SEQ ID NO: 5701 - protein, 154 aa, Homo sapiens
  Payload ID: 1256;
  Gene Symbol: APOBEC3H;
  Gene Name: apolipoprt B mRNA editing enzyme, catalytic polypeptide-like 3H;
  Uniprot ID:  Q6NTF7;
  ENSP ID: ENSP00000393520
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPDSRGTCAGSLHGYIV

SEQ ID NO: 5702 - protein, 183 aa, Homo sapiens
  Payload ID: 1256;
  Gene Symbol: APOBEC3H;
  Gene Name: apolipoprt B mRNA editing enzyme, catalytic polypeptide-like 3H;
  Uniprot ID:  Q6NTF7;
  ENSP ID: ENSP00000411754
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPEFADCWENFVDHEKPLSFNPYKMLEELDKNSRAIKRRLERIKQS

SEQ ID NO: 5703 - protein, 154 aa, Homo sapiens; identical to SEQ ID NO: 5701
  Payload ID: 1256;
  Gene Symbol: APOBEC3H;
  Gene Name: apolipoprt B mRNA editing enzyme, catalytic polypeptide-like 3H;
  ENSP ID: ENSP00000482682

SEQ ID NO: 5704 - protein, 200 aa, Homo sapiens; identical to SEQ ID NO: 5700
  Payload ID: 1256;
  Gene Symbol: APOBEC3H;
  Gene Name: apolipoprt B mRNA editing enzyme, catalytic polypeptide-like 3H;
  ENSP ID: ENSP00000483689

SEQ ID NO: 5705 - protein, 367 aa, Homo sapiens
  Payload ID: 1257;
  Gene Symbol: APOBEC4;
  Gene Name: apolipoprt B mRNA editing enzyme, catalytic polypeptide-like 4 (putative);
  Uniprot ID:  Q8WW27;
  ENSP ID: ENSP00000310622
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGRSVEIVEITEQFASSKEADEKKKKKGKK

SEQ ID NO: 5706 - protein, 1088 aa, Homo sapiens
  Payload ID: 1258;
  Gene Symbol: APOBR;
  Gene Name: apolipoprt B receptor;
  Uniprot ID:  Q0VD83;
  ENSP ID: ENSP00000416094
MDFLRLYLPGLHQALRGALDSLGTFVSYLLGDAVPTVEREAQAAEELGVVAVGKTGKIVEEEAQEDLEGLRGSQNEGAGRLRGPGDDRRHEVGSSAVEQTWGWGDGSSHGSQAERQDSGAGETAKAARCQEPSAHLEARKKSKAGSGACQDRSGQAQERQESHEQEVNREERLRSWEQEEEEEEVRAREPGMARGAESEWTWHGETEGKAGAVGPKAAGDNREMEQGVREADAGETEEPGAEGAGKGEEVVVVEKACESTRAWGTWGPGAEPEDWGILGREEARTTPGREEARAILDGEEARTISGGEEAETASGGEEAETASGGEEAGTASGGEEAGIASGGEAGTASGGEEAGTASGGDEAWTTSGKEEADLLGVRQTEYGAVPGERLLEATGKVWVLEEEGDEEREAEVSPFPKQPQVLGTERTEEAAESQTAGREAVGGQEAGESFEGQVDLRGKEAEMRQDLGIRADRARMEELVQAEEAQEERGSSRDPVAELPSDGEAEGTADLEATPEARPEEELTGEESEAAQTSCGLLGVEWGGLTHSVTKGQGPELMGGAQTPTKQPEEREAGEVELMGVLALSKEEQERSLEAGPRHAGSVKPEASEAFPGAWENRTRKDMERGNTQEDAADGEQREEEETAGGQTLAAEAEGDRESELSEVPEAGGEGLTTQDAGCGTEEGEASVSENQELDGSTGADAGPCPSLGEAYARETEDEEAEADRTSRRGWRLQAVAVGLPDREDAQTGSVAAGIMGGDVVPHISAAGAGEALEGVLGQGWDSKEKEEAAAGEHAGGQEFGLEGSAEEEVTGRGSQVEAFESREGGPWGGRVEAEESAGAEDSCGLDPAGSQTARAEGMGAMVEAGGLLEKWTLLEEEAVGWQEREQREDSEGRCGDYHPEGEAPRLLDAEGLMVTGGRRAEAKETEPESLEHVRGQEEQPTHQAPAEAAPESVGEAETAEAMGSARGGAANSWSEAPLPGSLLDVSVPRSRVHLSRSSSQRRSRPSFRRTPAWEQQEEPPAPNPPEEELSAPEQRPLQLEEPLEPSPLRHDGTPVPARRRPLGHGFGLAHPGMMQELQARLGRPKPQ

SEQ ID NO: 5707 - protein, 1097 aa, Homo sapiens
  Payload ID: 1258;
  Gene Symbol: APOBR;
  Gene Name: apolipoprt B receptor;
  Uniprot ID:  Q0VD83;
  ENSP ID: ENSP00000457539
MDFLRLYLPGLHQALRGALDSLGTFVSYLLGDAVPTVEREAQAAEELGVVAVGKTGKIVEEEAQEDLEGLRGSQNEGAGRLRGPGDDRRHEVGSSAVEQTWGWGDGSSHGSQAERQDSGAGETAKAARCQEPSAHLEARKKSKAGSGACQDRSGQAQERQESHEQEVNREERLRSWEQEEEEEEVRAREPGMARGAESEWTWHGETEGKAGAVGPKAAGDNREMEQGVREADAGETEEPGAEGAGKGEEVVVVEKACESTRAWGTWGPGAEPEDWGILGREEARTTPGREEARAILDGEEARTISGGEEAETASGGEEAETASGGEEAGTASGGEEAGIASGGEAGTASGGEEAGTASGGEEAGTASGGDEAWTTSGKEEADLLGVRQTEYGAVPGERLLEATGKVWVLEEEGDEEREAEVSPFPKQPQVLGTERTEEAAESQTAGREAVGGQEAGESFEGQVDLRGKEAEMRQDLGIRADRARMEELVQAEEAQEERGSSRDPVAELPSDGEAEGTADLEATPEARPEEELTGEESEAAQTSCGLLGVEWGGLTHSVTKGQGPELMGGAQTPTKQPEEREAGEVELMGVLALSKEEQERSLEAGPRHAGSVKPEASEAFPGAWENRTRKDMERGNTQEDAADGEQREEEETAGGQTLAAEAEGDRESELSEVPEAGGEGLTTQDAGCGTEEGEASVSENQELDGSTGADAGPCPSLGEAYARETEDEEAEADRTSRRGWRLQAVAVGLPDREDAQTGSVAAGIMGGDVVPHISAAGAGEALEGVLGQGWDSKEKEEAAAGEHAGGQEFGLEGSAEEEVTGRGSQVEAFESREGGPWGGRVEAEESAGAEDSCGLDPAGSQTARAEGMGAMVEAGGLLEKWTLLEEEAVGWQEREQREDSEGRCGDYHPEGEAPRLLDAEGLMVTGGRRAEAKETEPESLEHVRGQEEQPTHQAPAEAAPESVGEAETAEAMGSARGGAANSWSEAPLPGSLLDVSVPRSRVHLSRSSSQRRSRPSFRRTPAWEQQEEPPAPNPPEEELSAPEQRPLQLEEPLEPSPLRHDGTPVPARRRPLGHGFGLAHPGMMQELQARLGRPKPQ

SEQ ID NO: 5708 - protein, 83 aa, Homo sapiens
  Payload ID: 1259;
  Gene Symbol: APOC1;
  Gene Name: apolipoprt C-I;
  ENSP ID: ENSP00000465190
MRLFLSLPVLVVVLSIVLEGPAPAQGTPDVSSALDKLKEFGNTLEDKARELISRIKQSELSAKMREDDISPCCPGWSRTPDLK

SEQ ID NO: 5709 - protein, 83 aa, Homo sapiens
  Payload ID: 1259;
  Gene Symbol: APOC1;
  Gene Name: apolipoprt C-I;
  Uniprot ID:  P02654;
  ENSP ID: ENSP00000465356
MRLFLSLPVLVVVLSIVLEGPAPAQGTPDVSSALDKLKEFGNTLEDKARELISRIKQSELSAKMREWFSETFQKVKEKLKIDS

SEQ ID NO: 5710 - protein, 53 aa, Homo sapiens
  Payload ID: 1259;
  Gene Symbol: APOC1;
  Gene Name: apolipoprt C-I;
  ENSP ID: ENSP00000465710
MRLFLSLPVLVVVLSIVLEGPAPAQGTPDVSSALDKLKEFGNTLEDKARELIS

SEQ ID NO: 5711 - protein, 92 aa, Homo sapiens
  Payload ID: 1259;
  Gene Symbol: APOC1;
  Gene Name: apolipoprt C-I;
  ENSP ID: ENSP00000466146
MRLFLSLPVLVVVLSIVLEGPAPAQGTPDVSSALDKLKEFGNTLEDKARELISRIKQSELSAKMRLEPFPGHGRAGGVVFRDISESEGETQD

SEQ ID NO: 5712 - protein, 39 aa, Homo sapiens
  Payload ID: 1259;
  Gene Symbol: APOC1;
  Gene Name: apolipoprt C-I;
  ENSP ID: ENSP00000466227
MRLFLSLPVLVVVLSIVLEGSPRLSPAGAKSAQESTSNR

SEQ ID NO: 5713 - protein, 129 aa, Homo sapiens
  Payload ID: 1259;
  Gene Symbol: APOC1;
  Gene Name: apolipoprt C-I;
  ENSP ID: ENSP00000467368
MRLFLSLPVLVVVLSIVLEGPAPAQGTPDVSSALDKLKEFGNTLEDKARELISRIKQSELSAKMRLEPFPGHGRAGVCFWVEPWQMVQDEQIEKKTSPGEADNIPLVTQLDLKGVVFRDISESEGETQD

SEQ ID NO: 5714 - protein, 29 aa, Homo sapiens
  Payload ID: 1259;
  Gene Symbol: APOC1;
  Gene Name: apolipoprt C-I;
  ENSP ID: ENSP00000467504
MRLFLSLPVLVVVLSIVLEGSGFQRHFRK

SEQ ID NO: 5715 - protein, 83 aa, Homo sapiens; identical to SEQ ID NO: 5709
  Payload ID: 1259;
  Gene Symbol: APOC1;
  Gene Name: apolipoprt C-I;
  Uniprot ID:  P02654;
  ENSP ID: ENSP00000468029

SEQ ID NO: 5716 - protein, 77 aa, Homo sapiens
  Payload ID: 1259;
  Gene Symbol: APOC1;
  Gene Name: apolipoprt C-I;
  ENSP ID: ENSP00000468276
MRLFLSLPVLVVVLSIVLEGPAPAQGTPDVSSALDKLKEFGNTLEDKARELISRIKQSELSAKMREWFSETFQKVKE

SEQ ID NO: 5717 - protein, 72 aa, Homo sapiens
  Payload ID: 1260;
  Gene Symbol: APOC2;
  Gene Name: apolipoprt C-II;
  ENSP ID: ENSP00000465001
MGTRLLPALFLVLLVLGFEVQGTQQPQQDEMPSPTFLTQVKESLSSYWESAKTAAQNLYEKTYLPAVDEKLR

SEQ ID NO: 5718 - protein, 101 aa, Homo sapiens; identical to SEQ ID NO: 5650
  Payload ID: 1260;
  Gene Symbol: APOC2;
  Gene Name: apolipoprt C-II;
  Uniprot ID:  P02655;
  ENSP ID: ENSP00000466775

SEQ ID NO: 5719 - protein, 87 aa, Homo sapiens
  Payload ID: 1260;
  Gene Symbol: APOC2;
  Gene Name: apolipoprt C-II;
  ENSP ID: ENSP00000476835
MGTRLLPALFLVLLVLGFEVQGTQQPQQDEMPSPTFLTQVKESLSSYWESAKTAAQNLDLYSKSTAAMSTYTGIFTDQVLSVLKGEE

SEQ ID NO: 5720 - protein, 47 aa, Homo sapiens
  Payload ID: 1260;
  Gene Symbol: APOC2;
  Gene Name: apolipoprt C-II;
  ENSP ID: ENSP00000477261
MGTRLLPALFLVLLVLGFGEGISLQLLGVSKDSRPEPVREDIPARCR

SEQ ID NO: 5721 - protein, 99 aa, Homo sapiens
  Payload ID: 1261;
  Gene Symbol: APOC3;
  Gene Name: apolipoprt C-III;
  Uniprot ID:  P02656;
  ENSP ID: ENSP00000227667
MQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 5722 - protein, 117 aa, Homo sapiens
  Payload ID: 1261;
  Gene Symbol: APOC3;
  Gene Name: apolipoprt C-III;
  ENSP ID: ENSP00000364494
MGTWGAPHRTLPCRNRGAMQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 5723 - protein, 55 aa, Homo sapiens
  Payload ID: 1261;
  Gene Symbol: APOC3;
  Gene Name: apolipoprt C-III;
  ENSP ID: ENSP00000410614
MQPRVLLVVALLALLASARASEAEDASLLSFMQGYMKHATKTAKDALSSVQESQV

SEQ ID NO: 5724 - protein, 117 aa, Homo sapiens; identical to SEQ ID NO: 5722
  Payload ID: 1261;
  Gene Symbol: APOC3;
  Gene Name: apolipoprt C-III;
  ENSP ID: ENSP00000486182

SEQ ID NO: 5725 - protein, 73 aa, Homo sapiens
  Payload ID: 1262;
  Gene Symbol: APOC4;
  Gene Name: apolipoprt C-IV;
  ENSP ID: ENSP00000466444
MSLLRNRLQALPALCLCVLVLACIGACQPEAQEGTLSPPPKLKMSRWSLVRGRMKELLETVVNRTRDGWQWFW

SEQ ID NO: 5726 - protein, 127 aa, Homo sapiens; identical to SEQ ID NO: 5651
  Payload ID: 1262;
  Gene Symbol: APOC4;
  Gene Name: apolipoprt C-IV;
  Uniprot ID:  P55056;
  ENSP ID: ENSP00000468236

SEQ ID NO: 5727 - protein, 189 aa, Homo sapiens
  Payload ID: 1263;
  Gene Symbol: APOD;
  Gene Name: apolipoprt D;
  Uniprot ID:  P05090;
  ENSP ID: ENSP00000345179
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 5728 - protein, 108 aa, Homo sapiens
  Payload ID: 1263;
  Gene Symbol: APOD;
  Gene Name: apolipoprt D;
  ENSP ID: ENSP00000391597
MVMLLLLLSALAGLFGAAEGQAFHLGKCPNPPVQENFDVNKTESHFVTQGGVQHHHLGSLQPPPPGFKQFSCLSLPSSWDYSISEDGTKLRRSQQPLRMDAASRPTTH

SEQ ID NO: 5729 - protein, 149 aa, Homo sapiens
  Payload ID: 1263;
  Gene Symbol: APOD;
  Gene Name: apolipoprt D;
  ENSP ID: ENSP00000393076
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWIL

SEQ ID NO: 5730 - protein, 215 aa, Homo sapiens
  Payload ID: 1263;
  Gene Symbol: APOD;
  Gene Name: apolipoprt D;
  ENSP ID: ENSP00000415235
MFKQLSCISLPSSCDYSSRSLLQPPSPKMVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPK

SEQ ID NO: 5731 - protein, 317 aa, Homo sapiens [sequence omitted]

SEQ ID NO: 5732 - protein, 219 aa, Homo sapiens
  Payload ID: 1264;
  Gene Symbol: APOE;
  Gene Name: apolipoprt E;
  ENSP ID: ENSP00000410423
MKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQ

SEQ ID NO: 5733 - protein, 216 aa, Homo sapiens
  Payload ID: 1264;
  Gene Symbol: APOE;
  Gene Name: apolipoprt E;
  ENSP ID: ENSP00000413135
MKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSL

SEQ ID NO: 5734 - protein, 269 aa, Homo sapiens
  Payload ID: 1264;
  Gene Symbol: APOE;
  Gene Name: apolipoprt E;
  ENSP ID: ENSP00000413653
MSSGASRKSWDPGNPWPPDWPITGRKMKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQPLQERAQAWGERLRARMEEMGSRT

SEQ ID NO: 5735 - protein, 326 aa, Homo sapiens
  Payload ID: 1265;
  Gene Symbol: APOF;
  Gene Name: apolipoprt F;
  Uniprot ID:  Q13790;
  ENSP ID: ENSP00000381250
MTGLCGYSAPDMRGLRLIMIPVELLLCYLLLHPVDATSYGKQTNVLMHFPLSLESQTPSSDPLSCQFLHPKSLPGFSHMAPLPKFLVSLALRNALEEAGCQADVWALQLQLYRQGGVNATQVLIQHLRGLQKGRSTERNVSVEALASALQLLAREQQSTGRVGRSLPTEDCENEKEQAVHNVVQLLPGVGTFYNLGTALYYATQNCLGKARERGRDGAIDLGYDLLMTMAGMSGGPMGLAISAALKPALRSGVQQLIQYYQDQKDANISQPETTKEGLRAISDVSDLEETTTLASFISEVVSSAPYWGWAIIKSYDLDPGAGSLEI

SEQ ID NO: 5736 - protein, 345 aa, Homo sapiens
  Payload ID: 1266;
  Gene Symbol: APOH;
  Gene Name: apolipoprt H (beta-2-glycoprt I);
  Uniprot ID:  P02749;
  ENSP ID: ENSP00000205948
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKVPVKKATVVYQGERVKIQEKFKNGMLHGDKVSFFCKNKEKKCSYTEDAQCIDGTIEVPKCFKEHSSLAFWKTDASDVKPC

SEQ ID NO: 5737 - protein, 104 aa, Homo sapiens
  Payload ID: 1266;
  Gene Symbol: APOH;
  Gene Name: apolipoprt H (beta-2-glycoprt I);
  ENSP ID: ENSP00000462260
  MOD_RES (1)..(1): Any amino acid
XQHAMFGNDTITCTTHGNWTKLPECREVKCPFPSRPDNGFVNYPAKPTLYYKDKATFGCHDGYSLDGPEEIECTKLGNWSAMPSCKEHSSLAFWKTDASDVKPC

SEQ ID NO: 5738 - protein, 200 aa, Homo sapiens
  Payload ID: 1266;
  Gene Symbol: APOH;
  Gene Name: apolipoprt H (beta-2-glycoprt I);
  ENSP ID: ENSP00000463553
MRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSC

SEQ ID NO: 5739 - protein, 181 aa, Homo sapiens
  Payload ID: 1266;
  Gene Symbol: APOH;
  Gene Name: apolipoprt H (beta-2-glycoprt I);
  ENSP ID: ENSP00000464301
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMF

SEQ ID NO: 5740 - protein, 279 aa, Homo sapiens
  Payload ID: 1267;
  Gene Symbol: APOLD1;
  Gene Name: apolipoprt L domain containing 1;
  Uniprot ID:  Q96LR9;
  ENSP ID: ENSP00000324277
MFRAPCHRLRARGTRKARAGAWRGCTFPCLGKGMERPAAREPHGPDALRRFQGLLLDRRGRLHGQVLRLREVARRLERLRRRSLVANVAGSSLSATGALAAIVGLSLSPVTLGTSLLVSAVGLGVATAGGAVTITSDLSLIFCNSRELRRVQEIAATCQDQMREILSCLEFFCRWQGCGDRQLLQCGRNASIALYNSVYFIVFFGSRGFLIPRRAEGDTKVSQAVLKAKIQKLAESLESCTGALDELSEQLESRVQLCTKSSRGHDLKISADQRAGLFF

SEQ ID NO: 5741 - protein, 248 aa, Homo sapiens
  Payload ID: 1267;
  Gene Symbol: APOLD1;
  Gene Name: apolipoprt L domain containing 1;
  Uniprot ID:  Q96LR9;
  ENSP ID: ENSP00000348998
MGMERPAAREPHGPDALRRFQGLLLDRRGRLHGQVLRLREVARRLERLRRRSLVANVAGSSLSATGALAAIVGLSLSPVTLGTSLLVSAVGLGVATAGGAVTITSDLSLIFCNSRELRRVQEIAATCQDQMREILSCLEFFCRWQGCGDRQLLQCGRNASIALYNSVYFIVFFGSRGFLIPRRAEGDTKVSQAVLKAKIQKLAESLESCTGALDELSEQLESRVQLCTKSSRGHDLKISADQRAGLFF

SEQ ID NO: 5742 - protein, 40 aa, Homo sapiens
  Payload ID: 1267;
  Gene Symbol: APOLD1;
  Gene Name: apolipoprt L domain containing 1;
  ENSP ID: ENSP00000454511
MFRAPCHRLRARGTRKARAGAWRGCTFPCLGKSVFAGGIC

SEQ ID NO: 5743 - protein, 40 aa, Homo sapiens; identical to SEQ ID NO: 5742
  Payload ID: 1267;
  Gene Symbol: APOLD1;
  Gene Name: apolipoprt L domain containing 1;
  ENSP ID: ENSP00000456719

SEQ ID NO: 5744 - protein, 414 aa, Homo sapiens
  Payload ID: 1268;
  Gene Symbol: APOL1;
  Gene Name: apolipoprt L, 1;
  Uniprot ID:  O14791;
  ENSP ID: ENSP00000317674
MRFKSHTVELRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 5745 - protein, 398 aa, Homo sapiens
  Payload ID: 1268;
  Gene Symbol: APOL1;
  Gene Name: apolipoprt L, 1;
  Uniprot ID:  O14791;
  ENSP ID: ENSP00000380448
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 5746 - protein, 398 aa, Homo sapiens; identical to SEQ ID NO: 5745
  Payload ID: 1268;
  Gene Symbol: APOL1;
  Gene Name: apolipoprt L, 1;
  Uniprot ID:  O14791;
  ENSP ID: ENSP00000380449

SEQ ID NO: 5747 - protein, 380 aa, Homo sapiens
  Payload ID: 1268;
  Gene Symbol: APOL1;
  Gene Name: apolipoprt L, 1;
  Uniprot ID:  O14791;
  ENSP ID: ENSP00000388477
MEGAALLRVSVLCIWVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 5748 - protein, 141 aa, Homo sapiens
  Payload ID: 1268;
  Gene Symbol: APOL1;
  Gene Name: apolipoprt L, 1;
  ENSP ID: ENSP00000391206
MEGAALLRVSVLCIWMSALFLGVGVRAEEAGARVQQNVPSGTDTGDPQSKPLGDWAAGTMDPGPAGSRGDSGEPCTLRPACRGQRQHGGASRISAEGPAPMPRRRTPSTAHLRVPKTSRRNLLCMRAVSLLRMPLSISRKK

SEQ ID NO: 5749 - protein, 159 aa, Homo sapiens
  Payload ID: 1268;
  Gene Symbol: APOL1;
  Gene Name: apolipoprt L, 1;
  ENSP ID: ENSP00000391302
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLR

SEQ ID NO: 5750 - protein, 141 aa, Homo sapiens; identical to SEQ ID NO: 5748
  Payload ID: 1268;
  Gene Symbol: APOL1;
  Gene Name: apolipoprt L, 1;
  ENSP ID: ENSP00000392514

SEQ ID NO: 5751 - protein, 142 aa, Homo sapiens
  Payload ID: 1268;
  Gene Symbol: APOL1;
  Gene Name: apolipoprt L, 1;
  ENSP ID: ENSP00000392857
MEGAALLRVSVLCIWMSALFLGVGVRAEEAGARVQQNVPSGTDTGDPQSKPLGDWAAGTMDPGPAGSRGDSGEPCTLRPACRGQRQHGGASRISAEGPAPMPRRRTPSTAHLRVPKTSRRNLLCMVVVLNAVEFETLFLNFK

SEQ ID NO: 5752 - protein, 123 aa, Homo sapiens
  Payload ID: 1268;
  Gene Symbol: APOL1;
  Gene Name: apolipoprt L, 1;
  ENSP ID: ENSP00000397141
MEGAALLRVSVLCIWVQQNVPSGTDTGDPQSKPLGDWAAGTMDPGPAGSRGDSGEPCTLRPACRGQRQHGGASRISAEGPAPMPRRRTPSTAHLRVPKTSRRNLLCMRAVSLLRMPLSISRKK

SEQ ID NO: 5753 - protein, 118 aa, Homo sapiens
  Payload ID: 1268;
  Gene Symbol: APOL1;
  Gene Name: apolipoprt L, 1;
  ENSP ID: ENSP00000404525
MRFKSHTVELRSTLSQPLFSCSRRRPCSDMEGAALLRVSVLCIWMSALFLGVGVRAEEAGARVQQNVPSGTDTGDPQSKPLGDWAAGTMDPESSIFIEDAIKYFKEKVSTQNLLLLLT

SEQ ID NO: 5754 - protein, 398 aa, Homo sapiens; identical to SEQ ID NO: 5745
  Payload ID: 1268;
  Gene Symbol: APOL1;
  Gene Name: apolipoprt L, 1;
  Uniprot ID:  O14791;
  ENSP ID: ENSP00000411507

SEQ ID NO: 5755 - protein, 337 aa, Homo sapiens
  Payload ID: 1269;
  Gene Symbol: APOL2;
  Gene Name: apolipoprt L, 2;
  Uniprot ID:  Q9BQE5;
  ENSP ID: ENSP00000249066
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHVIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 5756 - protein, 337 aa, Homo sapiens; identical to SEQ ID NO: 5755
  Payload ID: 1269;
  Gene Symbol: APOL2;
  Gene Name: apolipoprt L, 2;
  Uniprot ID:  Q9BQE5;
  ENSP ID: ENSP00000351292

SEQ ID NO: 5757 - protein, 74 aa, Homo sapiens
  Payload ID: 1269;
  Gene Symbol: APOL2;
  Gene Name: apolipoprt L, 2;
  ENSP ID: ENSP00000400486
MNPESSIFIEDYLKYFQDQVSRENLLQLLTDDEAWNGFVAAAELPRDEADELRKALNKLASHMVMKDKNRHDKD

SEQ ID NO: 5758 - protein, 449 aa, Homo sapiens
  Payload ID: 1269;
  Gene Symbol: APOL2;
  Gene Name: apolipoprt L, 2;
  ENSP ID: ENSP00000403153
MHSWTWDPHSSEQLDLAQSLSEEDPLSSLRGSIQPQPPAEAPDKGGSQANNDPGGWDPGCSSSQVLGRTRGPCLGVRVREEEAGTRVKENLPVWTVTGELQGKPLGNPAAGTMNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHVIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 5759 - protein, 128 aa, Homo sapiens
  Payload ID: 1269;
  Gene Symbol: APOL2;
  Gene Name: apolipoprt L, 2;
  ENSP ID: ENSP00000431231
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSG

SEQ ID NO: 5760 - protein, 402 aa, Homo sapiens
  Payload ID: 1270;
  Gene Symbol: APOL3;
  Gene Name: apolipoprt L, 3;
  Uniprot ID:  O95236;
  ENSP ID: ENSP00000344577
MGLGQGWGWEASCFACLIRSCCQVVTFTFPFGFQGISQSLENVSGYYADARLEVGSTQLRTAGSCSHSFKRSFLEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 5761 - protein, 202 aa, Homo sapiens
  Payload ID: 1270;
  Gene Symbol: APOL3;
  Gene Name: apolipoprt L, 3;
  Uniprot ID:  O95236;
  ENSP ID: ENSP00000355164
MSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 5762 - protein, 202 aa, Homo sapiens; identical to SEQ ID NO: 5761
  Payload ID: 1270;
  Gene Symbol: APOL3;
  Gene Name: apolipoprt L, 3;
  Uniprot ID:  O95236;
  ENSP ID: ENSP00000380456

SEQ ID NO: 5763 - protein, 97 aa, Homo sapiens
  Payload ID: 1270;
  Gene Symbol: APOL3;
  Gene Name: apolipoprt L, 3;
  ENSP ID: ENSP00000380457
MGLGQGWGWEASCFACLIRSCCQVVTFTFPFGFQGISQSLENVSGYYADARLEVGSTQLRTAGSCSHSFKRSFLGLRKKTNPSSQVSDWRAPWKVSQ

SEQ ID NO: 5764 - protein, 202 aa, Homo sapiens; identical to SEQ ID NO: 5761
  Payload ID: 1270;
  Gene Symbol: APOL3;
  Gene Name: apolipoprt L, 3;
  Uniprot ID:  O95236;
  ENSP ID: ENSP00000380461

SEQ ID NO: 5765 - protein, 52 aa, Homo sapiens
  Payload ID: 1270;
  Gene Symbol: APOL3;
  Gene Name: apolipoprt L, 3;
  ENSP ID: ENSP00000391174
  MOD_RES (1)..(1): Any amino acid
XYADARLEVGSTQLRTAGSCSHSFKRSFLGLRKKTNPSSQVSDWRAPWKVSQ

SEQ ID NO: 5766 - protein, 82 aa, Homo sapiens
  Payload ID: 1270;
  Gene Symbol: APOL3;
  Gene Name: apolipoprt L, 3;
  ENSP ID: ENSP00000409345
MGLGQGWGWEASCFACLIRSCCQVVTFTFPFGFQGISQSLENVSGYYADARLEVGSTQLRTAGSCSHSFKRSFLGQKDPALV

SEQ ID NO: 5767 - protein, 331 aa, Homo sapiens
  Payload ID: 1270;
  Gene Symbol: APOL3;
  Gene Name: apolipoprt L, 3;
  Uniprot ID:  O95236;
  ENSP ID: ENSP00000415779
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 5768 - protein, 82 aa, Homo sapiens; identical to SEQ ID NO: 5766
  Payload ID: 1270;
  Gene Symbol: APOL3;
  Gene Name: apolipoprt L, 3;
  ENSP ID: ENSP00000416732

SEQ ID NO: 5769 - protein, 40 aa, Homo sapiens
  Payload ID: 1270;
  Gene Symbol: APOL3;
  Gene Name: apolipoprt L, 3;
  ENSP ID: ENSP00000432271
SQSLENVSGYYADARLEVGSTQLRTAGSCSHSFKRSFLGE

SEQ ID NO: 5770 - protein, 86 aa, Homo sapiens
  Payload ID: 1270;
  Gene Symbol: APOL3;
  Gene Name: apolipoprt L, 3;
  ENSP ID: ENSP00000432868
  MOD_RES (1)..(1): Any amino acid
XYADARLEVGSTQLRTAGSCSHSFKRSFLAWWYVPVGTTTWEVEAEASLAARTYRQKQGGQRVSSTAPVNSPRQTLGHRVQDTDLE

SEQ ID NO: 5771 - protein, 33 aa, Homo sapiens
  Payload ID: 1270;
  Gene Symbol: APOL3;
  Gene Name: apolipoprt L, 3;
  ENSP ID: ENSP00000433618
  MOD_RES (1)..(1): Any amino acid
XYADARLEVGSTQLRTAGSCSHSFKRSFLEMSI

SEQ ID NO: 5772 - protein, 52 aa, Homo sapiens; identical to SEQ ID NO: 5765
  Payload ID: 1270;
  Gene Symbol: APOL3;
  Gene Name: apolipoprt L, 3;
  ENSP ID: ENSP00000434449
  MOD_RES (1)..(1): Any amino acid

SEQ ID NO: 5773 - protein, 37 aa, Homo sapiens
  Payload ID: 1270;
  Gene Symbol: APOL3;
  Gene Name: apolipoprt L, 3;
  ENSP ID: ENSP00000435958
  MOD_RES (1)..(1): Any amino acid
XYADARLEVGSTQLRTAGSCSHSFKRSFLGQKDPALV

SEQ ID NO: 5774 - protein, 39 aa, Homo sapiens
  Payload ID: 1270;
  Gene Symbol: APOL3;
  Gene Name: apolipoprt L, 3;
  ENSP ID: ENSP00000436331
  MOD_RES (1)..(1): Any amino acid
XYADARLEVGSTQLRTAGSCSHSFKRSFLAWLPQPPRFL

SEQ ID NO: 5775 - protein, 107 aa, Homo sapiens
  Payload ID: 1271;
  Gene Symbol: APOL4;
  Gene Name: apolipoprt L, 4;
  ENSP ID: ENSP00000331089
MGSWVQLITSVGTSGLFLGVRVREEGAGMRCSKTIQAGQWLDSSKGPLGPSPPPVPTAGYSSSFCVHYVNLLPGVLVLSVTSQYPHLSMALCQLAAHDWPRLSCVCV

SEQ ID NO: 5776 - protein, 348 aa, Homo sapiens
  Payload ID: 1271;
  Gene Symbol: APOL4;
  Gene Name: apolipoprt L, 4;
  Uniprot ID:  Q9BPW4;
  ENSP ID: ENSP00000333229
MGSWVQLITSVGVQQNHPGWTVAGQFQEKKRFTEEVIEYFQKKVSPVHLKILLTSDEAWKRFVRVAELPREEADALYEALKNLTPYVAIEDKDMQQKEQQFREWFLKEFPQIRWKIQESIERLRVIANEIEKVHRGCVIANVVSGSTGILSVIGVMLAPFTAGLSLSITAAGVGLGIASATAGIASSIVENTYTRSAELTASRLTATSTDQLEALRDILRDITPNVLSFALDFDEATKMIANDVHTLRRSKATVGRPLIAWRYVPINVVETLRTRGAPTRIVRKVARNLGKATSGVLVVLDVVNLVQDSLDLHKGAKSESAESLRQWAQELEENLNELTHIHQSLKAG

SEQ ID NO: 5777 - protein, 351 aa, Homo sapiens
  Payload ID: 1271;
  Gene Symbol: APOL4;
  Gene Name: apolipoprt L, 4;
  Uniprot ID:  Q9BPW4;
  ENSP ID: ENSP00000338260
MEGAALLKIFVVCIWVQQNHPGWTVAGQFQEKKRFTEEVIEYFQKKVSPVHLKILLTSDEAWKRFVRVAELPREEADALYEALKNLTPYVAIEDKDMQQKEQQFREWFLKEFPQIRWKIQESIERLRVIANEIEKVHRGCVIANVVSGSTGILSVIGVMLAPFTAGLSLSITAAGVGLGIASATAGIASSIVENTYTRSAELTASRLTATSTDQLEALRDILRDITPNVLSFALDFDEATKMIANDVHTLRRSKATVGRPLIAWRYVPINVVETLRTRGAPTRIVRKVARNLGKATSGVLVVLDVVNLVQDSLDLHKGAKSESAESLRQWAQELEENLNELTHIHQSLKAG

SEQ ID NO: 5778 - protein, 107 aa, Homo sapiens; identical to SEQ ID NO: 5775
  Payload ID: 1271;
  Gene Symbol: APOL4;
  Gene Name: apolipoprt L, 4;
  ENSP ID: ENSP00000380445

SEQ ID NO: 5779 - protein, 25 aa, Homo sapiens
  Payload ID: 1271;
  Gene Symbol: APOL4;
  Gene Name: apolipoprt L, 4;
  ENSP ID: ENSP00000393096
MGSWVQLITSVGVQQNHPGWTVAGQ

SEQ ID NO: 5780 - protein, 64 aa, Homo sapiens
  Payload ID: 1271;
  Gene Symbol: APOL4;
  Gene Name: apolipoprt L, 4;
  ENSP ID: ENSP00000395548
MGSWVQLITSVGVQQNHPGWTVAGQFQEKKRFTEEVIEYFQKKVSPVHLKILLTSDEAWKRFVR

SEQ ID NO: 5781 - protein, 72 aa, Homo sapiens
  Payload ID: 1271;
  Gene Symbol: APOL4;
  Gene Name: apolipoprt L, 4;
  ENSP ID: ENSP00000409085
MGSWVQLITSVGVQQNHPGWTVAGQFQEKKRFTEEVIEYFQKKVSPVHLKILLTSDEAWKRFVRVAELPREE

SEQ ID NO: 5782 - protein, 70 aa, Homo sapiens
  Payload ID: 1271;
  Gene Symbol: APOL4;
  Gene Name: apolipoprt L, 4;
  ENSP ID: ENSP00000432133
MGSWVQLITSVGVQQNHPGWTVAGQFQEKKRFTEEVIEYFQKKVSPVHLKILLTSDEAWKRFVRVAELPR

SEQ ID NO: 5783 - protein, 348 aa, Homo sapiens; identical to SEQ ID NO: 5776
  Payload ID: 1271;
  Gene Symbol: APOL4;
  Gene Name: apolipoprt L, 4;
  Uniprot ID:  Q9BPW4;
  ENSP ID: ENSP00000483497

SEQ ID NO: 5784 - protein, 433 aa, Homo sapiens
  Payload ID: 1272;
  Gene Symbol: APOL5;
  Gene Name: apolipoprt L, 5;
  Uniprot ID:  Q9BWW9;
  ENSP ID: ENSP00000249044
MPCGKQGNLQVPGSKVLPGLGEGCKEMWLRKVIYGGEVWGKSPEPEFPSLVNLCQSWKINNLMSTVHSDEAGMLSYFLFEELMRCDKDSMPDGNLSEEEKLFLSYFPLHKFELEQNIKELNTLADQVDTTHELLTKTSLVASSSGAVSGVMNILGLALAPVTAGGSLMLSATGTGLGAAAAITNIVTNVLENRSNSAARDKASRLGPLTTSHEAFGGINWSEIEAAGFCVNKCVKAIQGIKDLHAYQMAKSNSGFMAMVKNFVAKRHIPFWTARGVQRAFEGTTLAMTNGAWVMGAAGAGFLLMKDMSSFLQSWKHLEDGARTETAEELRALAKKLEQELDRLTQHHRHLPQKASQTCSSSRGRAVRGSRVVKPEGSRSPLPWPVVEHQPRLGPGVALRTPKRTVSAPRMLGHQPAPPAPARKGRQAPGRHRQ

SEQ ID NO: 5785 - protein, 433 aa, Homo sapiens
  Payload ID: 1272;
  Gene Symbol: APOL5;
  Gene Name: apolipoprt L, 5;
  ENSP ID: ENSP00000479050
MPCGKQGNLQVPGSKVLPGLGEGCKEMWLRKVIYGGEVWGKSPEPEFPSLVNLCQSWKINNLMSTVHSDEAGMLSYFLFEELMRCDKDSMPDGNLSEEEKLFLSYFPLHKFELEQNIKELNTLADQVDTTHELLTKTSLVASSSGAVSGVMNILGLALAPVTAGGSLMLSATGTGLGAAAAITNIVTNVLENRSNSAARDKASRLGPLTTSHEAFGGINWSEIEAAGFCVNKCVKAIQGIKDLHAYQMAKSNSGFMAMVKNFVAKRHIPFWMARGVQRAFEGTTLAMTNGAWVMGAAGAGFLLMKDMSSFLQSWKHLEDGARTETAEELRALAKKLEQELDRLTQHHRHLPQKASQTCSSSRGRAVRGSRVVKPEGSRSPLPWPVVEHQPRLGPGVALRTPKRTVCAPRMLGHQPAPPAPARKGRQAPGRHRQ

SEQ ID NO: 5786 - protein, 343 aa, Homo sapiens
  Payload ID: 1273;
  Gene Symbol: APOL6;
  Gene Name: apolipoprt L, 6;
  Uniprot ID:  Q9BWW8;
  ENSP ID: ENSP00000386280
MDNQAERESEAGVGLQRDEDDAPLCEDVELQDGDLSPEEKIFLREFPRLKEDLKGNIDKLRALADDIDKTHKKFTKANMVATSTAVISGVMSLLGLALAPATGGGSLLLSTAGQGLATAAGVTSIVSGTLERSKNKEAQARAEDILPTYDQEDREDEEEKADYVTAAGKIIYNLRNTLKYAKKNVRAFWKLRANPRLANATKRLLTTGQVSSRSRVQVQKAFAGTTLAMTKNARVLGGVMSAFSLGYDLATLSKEWKHLKEGARTKFAEELRAKALELERKLTELTQLYKSLQQKVRSRARGVGKDLTGTCETEAYWKELREHVWMWLWLCVCLCVCVYVQFT

SEQ ID NO: 5787 - protein, 188 aa, Homo sapiens
  Payload ID: 1274;
  Gene Symbol: APOM;
  Gene Name: apolipoprt M;
  Uniprot ID:  O95445;
  ENSP ID: ENSP00000365081
MFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 5788 - protein, 129 aa, Homo sapiens
  Payload ID: 1274;
  Gene Symbol: APOM;
  Gene Name: apolipoprt M;
  ENSP ID: ENSP00000365083
MAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQGKGLKSHKTGLGLTKSSGVTG

SEQ ID NO: 5789 - protein, 116 aa, Homo sapiens
  Payload ID: 1274;
  Gene Symbol: APOM;
  Gene Name: apolipoprt M;
  Uniprot ID:  O95445;
  ENSP ID: ENSP00000365085
MAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 5790 - protein, 188 aa, Homo sapiens; identical to SEQ ID NO: 5787
  Payload ID: 1274;
  Gene Symbol: APOM;
  Gene Name: apolipoprt M;
  Uniprot ID:  O95445;
  ENSP ID: ENSP00000372930

SEQ ID NO: 5791 - protein, 116 aa, Homo sapiens; identical to SEQ ID NO: 5789
  Payload ID: 1274;
  Gene Symbol: APOM;
  Gene Name: apolipoprt M;
  Uniprot ID:  O95445;
  ENSP ID: ENSP00000383021

SEQ ID NO: 5792 - protein, 188 aa, Homo sapiens; identical to SEQ ID NO: 5787
  Payload ID: 1274;
  Gene Symbol: APOM;
  Gene Name: apolipoprt M;
  Uniprot ID:  O95445;
  ENSP ID: ENSP00000389591

SEQ ID NO: 5793 - protein, 116 aa, Homo sapiens; identical to SEQ ID NO: 5789
  Payload ID: 1274;
  Gene Symbol: APOM;
  Gene Name: apolipoprt M;
  Uniprot ID:  O95445;
  ENSP ID: ENSP00000392021

SEQ ID NO: 5794 - protein, 129 aa, Homo sapiens; identical to SEQ ID NO: 5788
  Payload ID: 1274;
  Gene Symbol: APOM;
  Gene Name: apolipoprt M;
  ENSP ID: ENSP00000392489

SEQ ID NO: 5795 - protein, 116 aa, Homo sapiens; identical to SEQ ID NO: 5789
  Payload ID: 1274;
  Gene Symbol: APOM;
  Gene Name: apolipoprt M;
  Uniprot ID:  O95445;
  ENSP ID: ENSP00000393581

SEQ ID NO: 5796 - protein, 188 aa, Homo sapiens; identical to SEQ ID NO: 5787
  Payload ID: 1274;
  Gene Symbol: APOM;
  Gene Name: apolipoprt M;
  Uniprot ID:  O95445;
  ENSP ID: ENSP00000394610

SEQ ID NO: 5797 - protein, 129 aa, Homo sapiens; identical to SEQ ID NO: 5788
  Payload ID: 1274;
  Gene Symbol: APOM;
  Gene Name: apolipoprt M;
  ENSP ID: ENSP00000395189

SEQ ID NO: 5798 - protein, 129 aa, Homo sapiens; identical to SEQ ID NO: 5788
  Payload ID: 1274;
  Gene Symbol: APOM;
  Gene Name: apolipoprt M;
  ENSP ID: ENSP00000397018

SEQ ID NO: 5799 - protein, 188 aa, Homo sapiens; identical to SEQ ID NO: 5787
  Payload ID: 1274;
  Gene Symbol: APOM;
  Gene Name: apolipoprt M;
  Uniprot ID:  O95445;
  ENSP ID: ENSP00000398944

SEQ ID NO: 5800 - protein, 188 aa, Homo sapiens; identical to SEQ ID NO: 5787
  Payload ID: 1274;
  Gene Symbol: APOM;
  Gene Name: apolipoprt M;
  Uniprot ID:  O95445;
  ENSP ID: ENSP00000401684

SEQ ID NO: 5801 - protein, 116 aa, Homo sapiens; identical to SEQ ID NO: 5789
  Payload ID: 1274;
  Gene Symbol: APOM;
  Gene Name: apolipoprt M;
  Uniprot ID:  O95445;
  ENSP ID: ENSP00000403062

SEQ ID NO: 5802 - protein, 188 aa, Homo sapiens; identical to SEQ ID NO: 5787
  Payload ID: 1274;
  Gene Symbol: APOM;
  Gene Name: apolipoprt M;
  Uniprot ID:  O95445;
  ENSP ID: ENSP00000405730

SEQ ID NO: 5803 - protein, 129 aa, Homo sapiens; identical to SEQ ID NO: 5788
  Payload ID: 1274;
  Gene Symbol: APOM;
  Gene Name: apolipoprt M;
  ENSP ID: ENSP00000412182

SEQ ID NO: 5804 - protein, 129 aa, Homo sapiens; identical to SEQ ID NO: 5788
  Payload ID: 1274;
  Gene Symbol: APOM;
  Gene Name: apolipoprt M;
  ENSP ID: ENSP00000413055

SEQ ID NO: 5805 - protein, 116 aa, Homo sapiens; identical to SEQ ID NO: 5789
  Payload ID: 1274;
  Gene Symbol: APOM;
  Gene Name: apolipoprt M;
  Uniprot ID:  O95445;
  ENSP ID: ENSP00000413446

SEQ ID NO: 5806 - protein, 129 aa, Homo sapiens; identical to SEQ ID NO: 5788
  Payload ID: 1274;
  Gene Symbol: APOM;
  Gene Name: apolipoprt M;
  ENSP ID: ENSP00000414574

SEQ ID NO: 5807 - protein, 116 aa, Homo sapiens; identical to SEQ ID NO: 5789
  Payload ID: 1274;
  Gene Symbol: APOM;
  Gene Name: apolipoprt M;
  Uniprot ID:  O95445;
  ENSP ID: ENSP00000416335

SEQ ID NO: 5808 - protein, 198 aa, Homo sapiens
  Payload ID: 1275;
  Gene Symbol: APOO;
  Gene Name: apolipoprt O;
  Uniprot ID:  Q9BUR5;
  ENSP ID: ENSP00000368528
MFKVIQRSVGPASLSLLTFKVYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 5809 - protein, 178 aa, Homo sapiens
  Payload ID: 1275;
  Gene Symbol: APOO;
  Gene Name: apolipoprt O;
  ENSP ID: ENSP00000402557
VYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 5810 - protein, 114 aa, Homo sapiens
  Payload ID: 1275;
  Gene Symbol: APOO;
  Gene Name: apolipoprt O;
  ENSP ID: ENSP00000434341
MFKVIQRSVGPASLSLLTFKVYAAPKKDSPPKNSVKVDELSLYSVPEGQSKYVEEARSQLEESISQLRHYCEPYTTWCQTAMTISKMHLLDFFRDLVLLVLLALLDSFWLEVQK

SEQ ID NO: 5811 - protein, 90 aa, Homo sapiens
  Payload ID: 1275;
  Gene Symbol: APOO;
  Gene Name: apolipoprt O;
  ENSP ID: ENSP00000488146
  MOD_RES (1)..(1): Any amino acid
XFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 5812 - protein, 81 aa, Homo sapiens
  Payload ID: 1275;
  Gene Symbol: APOO;
  Gene Name: apolipoprt O;
  ENSP ID: ENSP00000488524
MQSLVQWGLDSYDYLQNAPPGFFPRLGVIGFAGLIGLLLARGSKIKKLVYPPGFMGLAASLYYPQQAIVFAQVSGERLYDW

SEQ ID NO: 5813 - protein, 49 aa, Homo sapiens
  Payload ID: 1275;
  Gene Symbol: APOO;
  Gene Name: apolipoprt O;
  ENSP ID: ENSP00000488538
  MOD_RES (1)..(1): Any amino acid
XGLLLARGSKIKKLVYPPGFMGLAASLYYPQQAIVFAQPGNVKNSPGTK

SEQ ID NO: 5814 - protein, 268 aa, Homo sapiens
  Payload ID: 1276;
  Gene Symbol: APOOL;
  Gene Name: apolipoprt O-like;
  Uniprot ID:  Q6UXV4;
  ENSP ID: ENSP00000362268
MAAIRMGKLTTMPAGLIYASVSVHAAKQEESKKQLVKPEQLPIYTAPPLQSKYVEEQPGHLQMGFASIRTATGCYIGWCKGVYVFVKNGIMDTVQFGKDAYVYLKNPPRDFLPKMGVITVSGLAGLVSARKGSKFKKITYPLGLATLGATVCYPVQSVIIAKVTAKKVYATSQQIFGAVKSLWTKSSKEESLPKPKEKTKLGSSSEIEVPAKTTHVLKHSVPLPTELSSEAKTKSESTSGATQFMPDPKLMDHGQSHPEDIDMYSTRS

SEQ ID NO: 5815 - protein, 263 aa, Homo sapiens [sequence omitted]

SEQ ID NO: 5816 - protein, 268 aa, Homo sapiens [sequence omitted]

SEQ ID NO: 5817 - protein, 206 aa, Homo sapiens
  Payload ID: 1277;
  Gene Symbol: APOPT1;
  Gene Name: apoptogenic 1, mitochondrial;
  Uniprot ID:  Q96IL0;
  ENSP ID: ENSP00000386485
MLPCAAGARGRGAMVVLRAGKKTFLPPLCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGQKATLNAEEMADFYKEFLSKNFQKHMYYNRDWYKRNFAITFFMGKVALERIWNKLKQKQKKRSN

SEQ ID NO: 5818 - protein, 118 aa, Homo sapiens
  Payload ID: 1277;
  Gene Symbol: APOPT1;
  Gene Name: apoptogenic 1, mitochondrial;
  ENSP ID: ENSP00000388067
AAVRRGSQGAWGHGGLAGGEEDLSPPSLPRLRLPRLSTRSGARRRAQGYGAQRGQKATLNAEEMADFYKEFLSKNFQKHMYYNRDWYKRNFAITFFMGKVALERIWNKLKQKQKKRSN

SEQ ID NO: 5819 - protein, 120 aa, Homo sapiens
  Payload ID: 1277;
  Gene Symbol: APOPT1;
  Gene Name: apoptogenic 1, mitochondrial;
  ENSP ID: ENSP00000408525
  MOD_RES (1)..(1): Any amino acid
XGARGRGAMVVLRAGKKTFLPPLCRAFACRGCQLAPERGAERRDTAPSGVSRFCPPRKSCHDWIGPPDKYSNLRPVHFYIPENESPLEQKLRKLRQETQEWNQQFWANQNLTFSKVRKQH

SEQ ID NO: 5820 - protein, 57 aa, Homo sapiens
  Payload ID: 1277;
  Gene Symbol: APOPT1;
  Gene Name: apoptogenic 1, mitochondrial;
  ENSP ID: ENSP00000450756
  MOD_RES (1)..(1): Any amino acid
XLRQETQEWNQQFWANQNLTFSKMESHSVTQAGVQWHDLGSLQTLPPGSSDSPASAF

SEQ ID NO: 5821 - protein, 108 aa, Homo sapiens
  Payload ID: 1277;
  Gene Symbol: APOPT1;
  Gene Name: apoptogenic 1, mitochondrial;
  ENSP ID: ENSP00000451703
LAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGGYDG

SEQ ID NO: 5822 - protein, 72 aa, Homo sapiens
  Payload ID: 1277;
  Gene Symbol: APOPT1;
  Gene Name: apoptogenic 1, mitochondrial;
  ENSP ID: ENSP00000451788
AFACRGCQLAPERGAERRDTAPSGPPQAFVQVLSRPIPNSPAAPRLPHQRPQSDGTEGAAATTPGTVDSQNL

SEQ ID NO: 5823 - protein, 177 aa, Homo sapiens
  Payload ID: 1277;
  Gene Symbol: APOPT1;
  Gene Name: apoptogenic 1, mitochondrial;
  ENSP ID: ENSP00000451874
MVVLRAGKKTFLPPLCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESDPTLPRVTETMERKTMDGGDSCAAAISLTQSESNIECRRNGGLLQGIFK

SEQ ID NO: 5824 - protein, 76 aa, Homo sapiens
  Payload ID: 1277;
  Gene Symbol: APOPT1;
  Gene Name: apoptogenic 1, mitochondrial;
  ENSP ID: ENSP00000489047
MADFYKEFLSKNFQKHMYYNRLDTVARTWNPMTLGGQEIGTSAILPSPSSWEKWPWKGFGTSLNRNKRRGATRSPL

SEQ ID NO: 5825 - protein, 55 aa, Homo sapiens
  Payload ID: 1277;
  Gene Symbol: APOPT1;
  Gene Name: apoptogenic 1, mitochondrial;
  ENSP ID: ENSP00000489152
MADFYKEFLSKNFQKHMYYNRDWYKRNFAITFFMGKVALERIWNKLKQKQKKRSN

SEQ ID NO: 5826 - protein, 132 aa, Homo sapiens
  Payload ID: 1277;
  Gene Symbol: APOPT1;
  Gene Name: apoptogenic 1, mitochondrial;
  ENSP ID: ENSP00000489308
GPPDKYSNLRPVHFYIPENESPLEQKLRKLRQETQEWNQQFWANQNLTFSKEKEEFIHSRLKTKGLGLRTESDGVSLCHPGWSAVARSRLTANSASWFKRFSCLSLLSSWDYRSESNIECRRNGGLLQGIFK

SEQ ID NO: 5827 - protein, 55 aa, Homo sapiens; identical to SEQ ID NO: 5825
  Payload ID: 1277;
  Gene Symbol: APOPT1;
  Gene Name: apoptogenic 1, mitochondrial;
  ENSP ID: ENSP00000489380

SEQ ID NO: 5828 - protein, 55 aa, Homo sapiens; identical to SEQ ID NO: 5825
  Payload ID: 1277;
  Gene Symbol: APOPT1;
  Gene Name: apoptogenic 1, mitochondrial;
  ENSP ID: ENSP00000489557

SEQ ID NO: 5829 - protein, 560 aa, Homo sapiens
  Payload ID: 1278;
  Gene Symbol: AATF;
  Gene Name: apoptosis antagonizing transcription factor;
  Uniprot ID:  Q9NY61;
  ENSP ID: ENSP00000477848
MAGPQPLALQLEQLLNPRPSEADPEADPEEATAARVIDRFDEGEDGEGDFLVVGSIRKLASASLLDTDKRYCGKTTSRKAWNEDHWEQTLPGSSDEEISDEEGSGDEDSEGLGLEEYDEDDLGAAEEQECGDHRESKKSRSHSAKTPGFSVQSISDFEKFTKGMDDLGSSEEEEDEESGMEEGDDAEDSQGESEEDRAGDRNSEDDGVVMTFSSVKVSEEVEKGRAVKNQIALWDQLLEGRIKLQKALLTTNQLPQPDVFPLFKDKGGPEFSSALKNSHKALKALLRSLVGLQEELLFQYPDTRYLVDGTKPNAGSEEISSEDDELVEEKKQQRRRVPAKRKLEMEDYPSFMAKRFADFTVYRNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLRFHVLSKLLSFMAPIDHTTMNDDARTELYRSLFGQLHPPDEGHGD

SEQ ID NO: 5830 - protein, 98 aa, Homo sapiens
  Payload ID: 1278;
  Gene Symbol: AATF;
  Gene Name: apoptosis antagonizing transcription factor;
  ENSP ID: ENSP00000477881
  MOD_RES (1)..(1): Any amino acid
XILPQAPANAHLKDLDEEIFDDDDFYHQLLRELIERKTSSLDPNDQVAMGRQWLAIQKLRSKIHKKVDRKASKGRKLRTELYRSLFGQLHPPDEGHGD

SEQ ID NO: 5831 - protein, 55 aa, Homo sapiens
  Payload ID: 1278;
  Gene Symbol: AATF;
  Gene Name: apoptosis antagonizing transcription factor;
  ENSP ID: ENSP00000479926
MAGPQPLALQLEQLLNPRPSEADPEADPEEATAARVIDRFDEGEDGEGSNYKKLC

SEQ ID NO: 5832 - protein, 154 aa, Homo sapiens
  Payload ID: 1278;
  Gene Symbol: AATF;
  Gene Name: apoptosis antagonizing transcription factor;
  ENSP ID: ENSP00000480472
RNRTLQKWHDKTKLASGKLGKGFGAFERSILTQIDHILMDKERLLRRTQTKRSVYRVLGKPEPAAQPVPESLPGEPEILPQAPANAHLKDLDEEIFDDDDFYHQLLRELIERKTSSLDPNDQVAMGRQWLAIQKLRSKIHKKVDRKASKGRKLR

SEQ ID NO: 5833 - protein, 560 aa, Homo sapiens; identical to SEQ ID NO: 5829
  Payload ID: 1278;
  Gene Symbol: AATF;
  Gene Name: apoptosis antagonizing transcription factor;
  Uniprot ID:  Q9NY61;
  ENSP ID: ENSP00000481894

SEQ ID NO: 5834 - protein, 98 aa, Homo sapiens; identical to SEQ ID NO: 5830
  Payload ID: 1278;
  Gene Symbol: AATF;
  Gene Name: apoptosis antagonizing transcription factor;
  ENSP ID: ENSP00000487925
  MOD_RES (1)..(1): Any amino acid

SEQ ID NO: 5835 - protein, 154 aa, Homo sapiens; identical to SEQ ID NO: 5832
  Payload ID: 1278;
  Gene Symbol: AATF;
  Gene Name: apoptosis antagonizing transcription factor;
  ENSP ID: ENSP00000488221

SEQ ID NO: 5836 - protein, 55 aa, Homo sapiens; identical to SEQ ID NO: 5831
  Payload ID: 1278;
  Gene Symbol: AATF;
  Gene Name: apoptosis antagonizing transcription factor;
  ENSP ID: ENSP00000488862

SEQ ID NO: 5837 - protein, 325 aa, Homo sapiens
  Payload ID: 1279;
  Gene Symbol: AEN;
  Gene Name: apoptosis enhancing nuclease;
  Uniprot ID:  Q8WTP8;
  ENSP ID: ENSP00000331944
MVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGNVLYDKYIRPEMPIADYRTRWSGITRQHMRKAVPFQVAQKEILKLLKGKVVVGHALHNDFQALKYVHPRSQTRDTTYVPNFLSEPGLHTRARVSLKDLALQLLHKKIQVGQHGHSSVEDATTAMELYRLVEVQWEQQEARSLWTCPEDREPDSSTDMEQYMEDQYWPDDLAHGSRGGAREAQDRRN

SEQ ID NO: 5838 - protein, 179 aa, Homo sapiens
  Payload ID: 1279;
  Gene Symbol: AEN;
  Gene Name: apoptosis enhancing nuclease;
  ENSP ID: ENSP00000453631
MVPREAPESAQCLCPSLTIPNAKDVLRKRHKRRSRQHQRFMARKALLQEQGLLSMPPEPGSSPLPTPFGAATATEAASSGKQCLRAGSGSAPCSRRPAPGKASGPLPSKCVAIDCEMVGTGPRGRVSELARCSIVSYHGNVLYDKYIRPEMPIADYRTRWSGITRQHMRKAVPFQVAQK

SEQ ID NO: 5839 - protein, 504 aa, Homo sapiens
  Payload ID: 1280;
  Gene Symbol: API5;
  Gene Name: apoptosis inhibitor 5;
  Uniprot ID:  Q9BZZ5;
  ENSP ID: ENSP00000368129
MPTVEELYRNYGILADATEQVGQHKDAYQVILDGVKGGTKEKRLAAQFIPKFFKHFPELADSAINAQLDLCEDEDVSIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYERSLQGK

SEQ ID NO: 5840 - protein, 513 aa, Homo sapiens
  Payload ID: 1280;
  Gene Symbol: API5;
  Gene Name: apoptosis inhibitor 5;
  Uniprot ID:  Q9BZZ5;
  ENSP ID: ENSP00000399341
MKQRWRENGIGKHKDAYQVILDGVKGGTKEKRLAAQFIPKFFKHFPELADSAINAQLDLCEDEDVSIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYEQRGAFRGSRGGRGWGTRGNRSRGRLY

SEQ ID NO: 5841 - protein, 450 aa, Homo sapiens
  Payload ID: 1280;
  Gene Symbol: API5;
  Gene Name: apoptosis inhibitor 5;
  Uniprot ID:  Q9BZZ5;
  ENSP ID: ENSP00000402540
MPTVEELYRNYGILADATEQVGQIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYERSLQGK

SEQ ID NO: 5842 - protein, 524 aa, Homo sapiens
  Payload ID: 1280;
  Gene Symbol: API5;
  Gene Name: apoptosis inhibitor 5;
  Uniprot ID:  Q9BZZ5;
  ENSP ID: ENSP00000431391
MPTVEELYRNYGILADATEQVGQHKDAYQVILDGVKGGTKEKRLAAQFIPKFFKHFPELADSAINAQLDLCEDEDVSIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYEQRGAFRGSRGGRGWGTRGNRSRGRLY

SEQ ID NO: 5843 - protein, 510 aa, Homo sapiens
  Payload ID: 1280;
  Gene Symbol: API5;
  Gene Name: apoptosis inhibitor 5;
  ENSP ID: ENSP00000434462
MPTVEELYRNYGILADATEQVGQHKDAYQVILDGVKGGTKEKRLAAQFIPKFFKHFPELADSAINAQLDLCEDEDVSIRRQAIKELPQFATGENLPRVADILTQLLQTDDSAEFNLVNNALLSIFKMDAKGTLGGLFSQILQGEDIVRERAIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSKNVHSTRFVTYFCEQVLPNLGTLTTPVEGLDIQLEVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQIYNPPSGKYSSNLGNFNYGERFRLGTRNMRD

SEQ ID NO: 5844 - protein, 123 aa, Homo sapiens
  Payload ID: 1280;
  Gene Symbol: API5;
  Gene Name: apoptosis inhibitor 5;
  ENSP ID: ENSP00000436189
MPTVEELYRNYGILADATEQVGQHKDAYQVILDGVKGGTKEKRLAAQFIPKFFKHFPELADSAINAQLDLCEDEDVSKTSAFFSIVMSLIYLNSTTHWIAGDVPLNRLLPSAKNLMFFIPLYV

SEQ ID NO: 5845 - protein, 294 aa, Homo sapiens
  Payload ID: 1280;
  Gene Symbol: API5;
  Gene Name: apoptosis inhibitor 5;
  ENSP ID: ENSP00000436436
AIKFLSTKLKTLPDEVLTKEVEELILTESKKVLEDVTGEEFVLFMKILSGLKSLQTVSGRQQLVELVAEQADLEQTFNPSDPDCVDRLLQCTRQAVPLFSVLKLLAEMSSFCGDMEKLETNLRKLFDKLLEYMPLPPEEAENGENAGNEEPKLQFSYVECLLYSFHQLGRKLPDFLTAKLNAEKLKDFKIRLQYFARGLQVYIRQLRLALQGKTGEALKTEENKIKVVALKITNNINVLIKDLFHIPPSYKSTVTLSWKPVQKVEIGQKRASEDTTSGSPPKKSSAGPKRDARQ

SEQ ID NO: 5846 - protein, 823 aa, Homo sapiens
  Payload ID: 1281;
  Gene Symbol: AREL1;
  Gene Name: apoptosis resistant E3 ubiquitin prt ligase 1;
  Uniprot ID:  O15033;
  ENSP ID: ENSP00000348714
MFYVIGGITVSVVAFFFTIKFLFELAARVVSFLQNEDRERRGDRTIYDYVRGNYLDPRSCKVSWDWKDPYEVGHSMAFRVHLFYKNGQPFPAHRPVGLRVHISHVELAVEIPVTQEVLQEPNSNVVKVAFTVRKAGRYEITVKLGGLNVAYSPYYKIFQPGMVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKVKKPKKVYCYVSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEALDWGGPRREWFELICKALFDTTNQLFTRFSDNNQALVHPNPNRPAHLRLKMYEFAGRLVGKCLYESSLGGAYKQLVRARFTRSFLAQIIGLRMHYKYFETDDPEFYKSKVCFILNNDMSEMELVFAEEKYNKSGQLDKVVELMTGGAQTPVTNANKIFYLNLLAQYRLASQVKEEVEHFLKGLNELVPENLLAIFDENELELLMCGTGDISVSDFKAHAVVVGGSWHFREKVMRWFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 5847 - protein, 129 aa, Homo sapiens
  Payload ID: 1281;
  Gene Symbol: AREL1;
  Gene Name: apoptosis resistant E3 ubiquitin prt ligase 1;
  ENSP ID: ENSP00000450458
MFYVIGGITVSVVAFFFTIKFLFELAARVVSFLQNEDRERRGDRTIYDYVRGNYLDPRSCKVSWDWKDPYEVGHSMAFRVHLFYKNGQPFPAHRPVGLRVHISHVELAVEIPVTQEVLQEPNSNVVKVA

SEQ ID NO: 5848 - protein, 504 aa, Homo sapiens
  Payload ID: 1281;
  Gene Symbol: AREL1;
  Gene Name: apoptosis resistant E3 ubiquitin prt ligase 1;
  ENSP ID: ENSP00000450557
MFYVIGGITVSVVAFFFTIKFLFELAARVVSFLQNEDRERRGDRTIYDYVRGNYLDPRSCKVSWDWKDPYEVGHSMAFRVHLFYKNGQPFPAHRPVGLRVHISHVELAVEIPVTQEVLQEPNSNVVKVAFTVRKAGRYEITVKLGGLNVAYSPYYKIFQPGMVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKVKKPKKVYCYVSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEGASQP

SEQ ID NO: 5849 - protein, 89 aa, Homo sapiens
  Payload ID: 1281;
  Gene Symbol: AREL1;
  Gene Name: apoptosis resistant E3 ubiquitin prt ligase 1;
  ENSP ID: ENSP00000450901
WFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 5850 - protein, 119 aa, Homo sapiens
  Payload ID: 1281;
  Gene Symbol: AREL1;
  Gene Name: apoptosis resistant E3 ubiquitin prt ligase 1;
  ENSP ID: ENSP00000450912
  MOD_RES (1)..(1): Any amino acid
XSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESE

SEQ ID NO: 5851 - protein, 81 aa, Homo sapiens
  Payload ID: 1281;
  Gene Symbol: AREL1;
  Gene Name: apoptosis resistant E3 ubiquitin prt ligase 1;
  ENSP ID: ENSP00000451375
VAFTVRKAGRYEITVKLGGLNVAYSPYYKIFQPGIGSHYVAQGGLELLDSSNLPALAFQSVGITGVSQVTQPDYCSSYNKS

SEQ ID NO: 5852 - protein, 131 aa, Homo sapiens
  Payload ID: 1281;
  Gene Symbol: AREL1;
  Gene Name: apoptosis resistant E3 ubiquitin prt ligase 1;
  ENSP ID: ENSP00000451710
  MOD_RES (1)..(1): Any amino acid
XCFHACISYQNQPINNGEFDIIVLSEDEKNIVERNVSTSGVSIYFEAYLYNATNCSSTPWHLPPMHMTSSQRRPSTAVDEEDEDSPSECHTPEKQFSVKEFYLKIIPWRLYTFRVCPGTKFSYLGPDPVHK

SEQ ID NO: 5853 - protein, 631 aa, Homo sapiens
  Payload ID: 1281;
  Gene Symbol: AREL1;
  Gene Name: apoptosis resistant E3 ubiquitin prt ligase 1;
  ENSP ID: ENSP00000452101
MVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKVKKPKKVYCYVSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEALDWGGPRREWFELICKALFDTTNQLFTRFSDNNQALVHPNPNRPAHLRLKMYEFAGRLVGKCLYESSLGGAYKQLVRARFTRSFLAQIIGLRMHYKYFETDDPEFYKSKVCFILNNDMSEMELVFAEEKYNKSGQLDKVVELMTGGAQTPVTNANKIFYLNLLAQYRLASQVKEEVEHFLKGLNELVPENLLAIFDENELELLMCGTGDISVSDFKAHAVVVGGSWHFREKVMRWFWTVVSSLTQEELARLLQFTTGSSQLPPGGFAALCPSFQIIAAPTHSTLPTAHTCFN

SEQ ID NO: 5854 - protein, 99 aa, Homo sapiens
  Payload ID: 1281;
  Gene Symbol: AREL1;
  Gene Name: apoptosis resistant E3 ubiquitin prt ligase 1;
  ENSP ID: ENSP00000452456
MFYVIGGITVSVVAFFFTIKFLFELAARVVSFLQNEDRERRGDRTIYDYVRGNYLDPRSCKVSWDWKDPYEVGHSMAFRVHEWWFLLRPKLCATFLLLY

SEQ ID NO: 5855 - protein, 362 aa, Homo sapiens
  Payload ID: 1282;
  Gene Symbol: AVEN;
  Gene Name: apoptosis, caspase activation inhibitor;
  Uniprot ID:  Q9NQS1;
  ENSP ID: ENSP00000306822
MQAERGARGGRGRRPGRGRPGGDRHSERPGAAAAVARGGGGGGGGDGGGRRGRGRGRGFRGARGGRGGGGAPRGSRREPGGWGAGASAPVEDDSDAETYGEENDEQGNYSKRKIVSNWDRYQDIEKEVNNESGESQRGTDFSVLLSSAGDSFSQFRFAEEKEWDSEASCPKQNSAFYVDSELLVRALQELPLCLRLNVAAELVQGTVPLEVPQVKPKRTDDGKGLGMQLKGPLGPGGRGPIFELKSVAAGCPVLLGKDNPSPGPSRDSQKPTSPLQSAGDHLEEELDLLLNLDAPIKEGDNILPDQTSQDLKSKEDGEVVQEEEVCAKPSVTEEKNMEPEQPSTSKNVTEEELEDWLDSMIS

SEQ ID NO: 5856 - protein, 59 aa, Homo sapiens
  Payload ID: 1282;
  Gene Symbol: AVEN;
  Gene Name: apoptosis, caspase activation inhibitor;
  ENSP ID: ENSP00000452906
  MOD_RES (1)..(1): Any amino acid
XDSFSQFRFAEEKEWDSEASCPKQNSAFYVDSELLVRALQELPLCLRLNVAAELVQMHL

SEQ ID NO: 5857 - protein, 1374 aa, Homo sapiens
  Payload ID: 1283;
  Gene Symbol: AATK;
  Gene Name: apoptosis-associated tyr kinase;
  Uniprot ID:  Q6ZMQ8;
  ENSP ID: ENSP00000324196
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 5858 - protein, 879 aa, Homo sapiens
  Payload ID: 1283;
  Gene Symbol: AATK;
  Gene Name: apoptosis-associated tyr kinase;
  Uniprot ID:  Q6ZMQ8;
  ENSP ID: ENSP00000363924
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQWPQREESLPRLCLLLRPRG

SEQ ID NO: 5859 - protein, 1271 aa, Homo sapiens
  Payload ID: 1283;
  Gene Symbol: AATK;
  Gene Name: apoptosis-associated tyr kinase;
  ENSP ID: ENSP00000398796
MAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 5860 - protein, 116 aa, Homo sapiens
  Payload ID: 1283;
  Gene Symbol: AATK;
  Gene Name: apoptosis-associated tyr kinase;
  ENSP ID: ENSP00000460202
MLTLCYLIARCIGRTRLAPGQQEFENAEGDEYAADLAQGSPATAAQNGPDVYVLPLTEVSLPMAKQPGRSVQLLKSTDVGRHSLLYLKEIGRGWFGKVFLGEVNSGISSAQVVVKE

SEQ ID NO: 5861 - protein, 105 aa, Homo sapiens
  Payload ID: 1283;
  Gene Symbol: AATK;
  Gene Name: apoptosis-associated tyr kinase;
  ENSP ID: ENSP00000460986
SEEASAPDAPDALPDSPTPATGGEVSAIKLASALNGSSSSPEVEAPSSEDEDTAEATSGIFTDTSSDGLQARRPDVVPAFRSLQKQWPQREESLPRLCLLLRPRG

SEQ ID NO: 5862 - protein, 613 aa, Homo sapiens
  Payload ID: 1284;
  Gene Symbol: AIFM1;
  Gene Name: apoptosis-inducing factor, mitochondrion-associated, 1;
  Uniprot ID:  O95831;
  ENSP ID: ENSP00000287295
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 5863 - protein, 609 aa, Homo sapiens
  Payload ID: 1284;
  Gene Symbol: AIFM1;
  Gene Name: apoptosis-inducing factor, mitochondrion-associated, 1;
  Uniprot ID:  O95831;
  ENSP ID: ENSP00000315122
MFRCGGLAAGALKQKLVPLVRTVCVRSPRQRNRLPVVQSHHLGSPSRSLASTGASGKDGSNLVYFLIVGATVTGAGVYYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 5864 - protein, 326 aa, Homo sapiens
  Payload ID: 1284;
  Gene Symbol: AIFM1;
  Gene Name: apoptosis-inducing factor, mitochondrion-associated, 1;
  Uniprot ID:  O95831;
  ENSP ID: ENSP00000316320
MFRCGGLAAGALKQKLVPLVRTVCVRSPRQRNRLPARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 5865 - protein, 324 aa, Homo sapiens
  Payload ID: 1284;
  Gene Symbol: AIFM1;
  Gene Name: apoptosis-inducing factor, mitochondrion-associated, 1;
  Uniprot ID:  O95831;
  ENSP ID: ENSP00000402535
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKDI

SEQ ID NO: 5866 - protein, 274 aa, Homo sapiens
  Payload ID: 1284;
  Gene Symbol: AIFM1;
  Gene Name: apoptosis-inducing factor, mitochondrion-associated, 1;
  ENSP ID: ENSP00000431222
MGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 5867 - protein, 89 aa, Homo sapiens
  Payload ID: 1284;
  Gene Symbol: AIFM1;
  Gene Name: apoptosis-inducing factor, mitochondrion-associated, 1;
  ENSP ID: ENSP00000432998
MFRCGGLAAGALKQKLVPLVRTVCVRSPRQRNRLPGNLFQRWHVPLELQMTRQMASSGASGGKIDNSVLVLIVGLSTVGAGAYLCSLIT

SEQ ID NO: 5868 - protein, 43 aa, Homo sapiens
  Payload ID: 1284;
  Gene Symbol: AIFM1;
  Gene Name: apoptosis-inducing factor, mitochondrion-associated, 1;
  ENSP ID: ENSP00000435955
MFRCGGLAAGALKQKLVPLVRTVCVRSPRQRNRLPGLQDYERG

SEQ ID NO: 5869 - protein, 324 aa, Homo sapiens; identical to SEQ ID NO: 5865
  Payload ID: 1284;
  Gene Symbol: AIFM1;
  Gene Name: apoptosis-inducing factor, mitochondrion-associated, 1;
  Uniprot ID:  O95831;
  ENSP ID: ENSP00000446113

SEQ ID NO: 5870 - protein, 373 aa, Homo sapiens
  Payload ID: 1285;
  Gene Symbol: AIFM2;
  Gene Name: apoptosis-inducing factor, mitochondrion-associated, 2;
  Uniprot ID:  Q9BRQ8;
  ENSP ID: ENSP00000312370
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEALPFSHLILATGSTGPFPGKFNEVSSQQAAIQAYEDMVRQVQRSRFIVVVGGGSAGVEMAAEIKTEYPEKEVTLIHSQVALADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 5871 - protein, 373 aa, Homo sapiens; identical to SEQ ID NO: 5870
  Payload ID: 1285;
  Gene Symbol: AIFM2;
  Gene Name: apoptosis-inducing factor, mitochondrion-associated, 2;
  Uniprot ID:  Q9BRQ8;
  ENSP ID: ENSP00000362345

SEQ ID NO: 5872 - protein, 373 aa, Homo sapiens; identical to SEQ ID NO: 5870
  Payload ID: 1285;
  Gene Symbol: AIFM2;
  Gene Name: apoptosis-inducing factor, mitochondrion-associated, 2;
  Uniprot ID:  Q9BRQ8;
  ENSP ID: ENSP00000478931

SEQ ID NO: 5873 - protein, 598 aa, Homo sapiens
  Payload ID: 1286;
  Gene Symbol: AIFM3;
  Gene Name: apoptosis-inducing factor, mitochondrion-associated, 3;
  Uniprot ID:  Q96NN9;
  ENSP ID: ENSP00000382116
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 5874 - protein, 605 aa, Homo sapiens
  Payload ID: 1286;
  Gene Symbol: AIFM3;
  Gene Name: apoptosis-inducing factor, mitochondrion-associated, 3;
  Uniprot ID:  Q96NN9;
  ENSP ID: ENSP00000382120
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVELFVLHSKTGDMSWLTGKGS

SEQ ID NO: 5875 - protein, 604 aa, Homo sapiens
  Payload ID: 1286;
  Gene Symbol: AIFM3;
  Gene Name: apoptosis-inducing factor, mitochondrion-associated, 3;
  Uniprot ID:  Q96NN9;
  ENSP ID: ENSP00000385800
MGGCFSKPKPGAALPTVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 5876 - protein, 605 aa, Homo sapiens; identical to SEQ ID NO: 5874
  Payload ID: 1286;
  Gene Symbol: AIFM3;
  Gene Name: apoptosis-inducing factor, mitochondrion-associated, 3;
  Uniprot ID:  Q96NN9;
  ENSP ID: ENSP00000390798

SEQ ID NO: 5877 - protein, 269 aa, Homo sapiens
  Payload ID: 1286;
  Gene Symbol: AIFM3;
  Gene Name: apoptosis-inducing factor, mitochondrion-associated, 3;
  ENSP ID: ENSP00000399657
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQ

SEQ ID NO: 5878 - protein, 129 aa, Homo sapiens
  Payload ID: 1286;
  Gene Symbol: AIFM3;
  Gene Name: apoptosis-inducing factor, mitochondrion-associated, 3;
  ENSP ID: ENSP00000402067
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCP

SEQ ID NO: 5879 - protein, 74 aa, Homo sapiens
  Payload ID: 1286;
  Gene Symbol: AIFM3;
  Gene Name: apoptosis-inducing factor, mitochondrion-associated, 3;
  ENSP ID: ENSP00000406989
MGGCFSKPKPVGRAAPGPTRAMARPATSTRRSACPPLTPTPALRIAWRLLSATSRTSRMARCGKWSWAGGRCCW

SEQ ID NO: 5880 - protein, 121 aa, Homo sapiens
  Payload ID: 1286;
  Gene Symbol: AIFM3;
  Gene Name: apoptosis-inducing factor, mitochondrion-associated, 3;
  ENSP ID: ENSP00000412973
MGGCFSKPKPVELKIEVVLPEKERGKEELSASGKGSPRAYQGNGTARHFHTEERLSTPHPYPSPQDCVEAAVCHVKDLENGQRSVPWSGALPLARRLLQHQHWGPGGLPWPGQSTQVPGED

SEQ ID NO: 5881 - protein, 138 aa, Homo sapiens; identical to SEQ ID NO: 5640
  Payload ID: 1287;
  Gene Symbol: APITD1;
  Gene Name: apoptosis-inducing, TAF9-like domain 1;
  Uniprot ID:  Q8N2Z9;
  ENSP ID: ENSP00000308583

SEQ ID NO: 5882 - protein, 78 aa, Homo sapiens
  Payload ID: 1287;
  Gene Symbol: APITD1;
  Gene Name: apoptosis-inducing, TAF9-like domain 1;
  ENSP ID: ENSP00000468629
MSSRRGSFLSTKLHCSSCLPCPLSFEKFKPSEKLQEHEAKGSSSLYCGLSLRGSCIGQRDAVQQTDHCGHFGADFPTV

SEQ ID NO: 5883 - protein, 49 aa, Homo sapiens; identical to SEQ ID NO: 5641
  Payload ID: 1287;
  Gene Symbol: APITD1;
  Gene Name: apoptosis-inducing, TAF9-like domain 1;
  ENSP ID: ENSP00000489524

SEQ ID NO: 5884 - protein, 1341 aa, Homo sapiens
  Payload ID: 1288;
  Gene Symbol: ACIN1;
  Gene Name: apoptotic chromatin condensation inducer 1;
  Uniprot ID:  Q9UKV3;
  ENSP ID: ENSP00000262710
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPAVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5885 - protein, 614 aa, Homo sapiens
  Payload ID: 1288;
  Gene Symbol: ACIN1;
  Gene Name: apoptotic chromatin condensation inducer 1;
  Uniprot ID:  Q9UKV3;
  ENSP ID: ENSP00000345541
MSPADRCRSANTIEPATTSSLALFLLLQRDQSSRTRGLPEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5886 - protein, 583 aa, Homo sapiens
  Payload ID: 1288;
  Gene Symbol: ACIN1;
  Gene Name: apoptotic chromatin condensation inducer 1;
  Uniprot ID:  Q9UKV3;
  ENSP ID: ENSP00000350073
MLSESKEGEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5887 - protein, 583 aa, Homo sapiens; identical to SEQ ID NO: 5886
  Payload ID: 1288;
  Gene Symbol: ACIN1;
  Gene Name: apoptotic chromatin condensation inducer 1;
  Uniprot ID:  Q9UKV3;
  ENSP ID: ENSP00000380502

SEQ ID NO: 5888 - protein, 1301 aa, Homo sapiens
  Payload ID: 1288;
  Gene Symbol: ACIN1;
  Gene Name: apoptotic chromatin condensation inducer 1;
  ENSP ID: ENSP00000405677
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEGKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPAVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5889 - protein, 582 aa, Homo sapiens
  Payload ID: 1288;
  Gene Symbol: ACIN1;
  Gene Name: apoptotic chromatin condensation inducer 1;
  ENSP ID: ENSP00000451138
MLSESKEGEEKEEVTMDTSENRPENDVPEPPMPIADQVSNDDRPEGSVEDEEKKESSLPKSFKRKISVVSTKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5890 - protein, 1328 aa, Homo sapiens
  Payload ID: 1288;
  Gene Symbol: ACIN1;
  Gene Name: apoptotic chromatin condensation inducer 1;
  Uniprot ID:  Q9UKV3;
  ENSP ID: ENSP00000451328
MWRRKHPRTSGGTRGVLSGNRGVEYGSGRGHLGTFEGRWRKLPKMPEAVGTDPSTSRKMAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPAVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSTKGVPAGNSDTEGGQPGRKRRWGASTATTQKKPSISITTESLKEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5891 - protein, 194 aa, Homo sapiens
  Payload ID: 1288;
  Gene Symbol: ACIN1;
  Gene Name: apoptotic chromatin condensation inducer 1;
  ENSP ID: ENSP00000451410
MLSESKEGEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKEAVVDLHADDSRISEDETERNGDDGTHDKGLKICRTVTQVVPAEGQENGQREEEEEEKEPEAEPPVPPQVSVEVALPPPA

SEQ ID NO: 5892 - protein, 1283 aa, Homo sapiens
  Payload ID: 1288;
  Gene Symbol: ACIN1;
  Gene Name: apoptotic chromatin condensation inducer 1;
  ENSP ID: ENSP00000474349
MAELEEVTLDGKPLQALRVTDLKAALEQRGLAKSGQKSALVKRLKGALMLENLQKHSTPHAAFQPNSQIGEEMSQNSFIKQYLEKQQELLRQRLEREAREAAELEEASAESEDEMIHPEGVASLLPPDFQSSLERPELELSRHSPRKSSSISEEKGDSDDEKPRKGERRSSRVRQARAAKLSEGSQPAEEEEDQETPSRNLRVRADRNLKTEEEEEEEEEEEEDDEEEEGDDEGQKSREAPILKEFKEEGEEIPRVKPEEMMDERPKTRSQEQEVLERGGRFTRSQEEARKSHLARQQQEKEMKTTSPLEEEEREIKSSQGLKEKSKSPSPPRLTEDRKKASLVALPEQTASEEETPPPLLTKEASSPPPHPQLHSEEEIEPMEGPAPAVLIQLSPPNTDADTRELLVSQHTVQLVGGLSPLSSPSDTKAESPAEKVPEESVLPLVQKSTLADYSAQKDLEPESDRSAQPLPLKIEELALAKGITEECLKQPSLEQKEGRRASHTLLPSHRLKQSADSSSSRSSSSSSSSSRSRSRSPDSSGSRSHSPLRSKQRDVAQARTHANPRGRPKMGSRSTSESRSRSRSRSRSASSNSRKSLSPGVSRDSSTSYTETKDPSSGQEVATPPVPQLQVCEPKERTSTSSSSVQARRLSQPESAEKHVTQRLQPERGSPKKCEAEEAEPPAATQPQTSETQTSHLPESERIHHTVEEKEEVTMDTSENRPENDVPEPPMPIADQVSNDDRPEGSVEDEEKKESSLPKSFKRKISVVSATKGVPAGNSDTEGGQPGRKRRWGASTATTQKKPSISITTESLKSLIPDIKPLAGQEAVVDLHADDSRISEDETERNGDDGTHDKGLKICRTVTQVVPAEGQENGQREEEEEEKEPEAEPPVPPQVSVEVALPPPAEHEVKKVTLGDTLTRRSISQQKSGVSITIDDPVRTAQVPSPPRGKISNIVHISNLVRPFTLGQLKELLGRTGTLVEEAFWIDKIKSHCFVTYSTVEEAVATRTALHGVKWPQSNPKFLCADYAEQDELDYHRGLLVDRPSETKTEEQGIPRPLHPPPPPPVQPPQHPRAEQREQERAVREQWAEREREMERRERTRSEREWDRDKVREGPRSRSRSRDRRRKERAKSKEKKSEKKEKAQEEPPAKLLDDLFRKTKAAPCIYWLPLTDSQIVQKEAERAERAKEREKRRKEQEEEEQKEREKEAERERNRQLEREKRREHSRERDRERERERERDRGDRDRDRERDRERGRERDRRDTKRHSRSRSRSTPVRDRGGRR

SEQ ID NO: 5893 - protein, 82 aa, Homo sapiens
  Payload ID: 1288;
  Gene Symbol: ACIN1;
  Gene Name: apoptotic chromatin condensation inducer 1;
  ENSP ID: ENSP00000481955
QPESAEKHVTQRLQPERGSPKKCEAEEAEPPAATQPQTSETQTSHLPESERIHHTVFFSGHSHASPGHMKLGVIEFPVPPLQ

SEQ ID NO: 5894 - protein, 36 aa, Homo sapiens
  Payload ID: 1288;
  Gene Symbol: ACIN1;
  Gene Name: apoptotic chromatin condensation inducer 1;
  ENSP ID: ENSP00000483298
  MOD_RES (1)..(1): Any amino acid
XNDDRPEGSVEDEEKKEYLMYGNPPVKYNPAQLANR

SEQ ID NO: 5895 - protein, 338 aa, Homo sapiens
  Payload ID: 1289;
  Gene Symbol: APAF1;
  Gene Name: apoptotic peptidase activating  factor 1;
  Uniprot ID:  O14727;
  ENSP ID: ENSP00000334558
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKVVERCHWGILTDLLHKWNQS

SEQ ID NO: 5896 - protein, 1205 aa, Homo sapiens
  Payload ID: 1289;
  Gene Symbol: APAF1;
  Gene Name: apoptotic peptidase activating  factor 1;
  Uniprot ID:  O14727;
  ENSP ID: ENSP00000349862
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 5897 - protein, 1194 aa, Homo sapiens
  Payload ID: 1289;
  Gene Symbol: APAF1;
  Gene Name: apoptotic peptidase activating  factor 1;
  Uniprot ID:  O14727;
  ENSP ID: ENSP00000353059
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 5898 - protein, 1163 aa, Homo sapiens
  Payload ID: 1289;
  Gene Symbol: APAF1;
  Gene Name: apoptotic peptidase activating  factor 1;
  ENSP ID: ENSP00000448161
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 5899 - protein, 1248 aa, Homo sapiens
  Payload ID: 1289;
  Gene Symbol: APAF1;
  Gene Name: apoptotic peptidase activating  factor 1;
  Uniprot ID:  O14727;
  ENSP ID: ENSP00000448165
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 5900 - protein, 1237 aa, Homo sapiens
  Payload ID: 1289;
  Gene Symbol: APAF1;
  Gene Name: apoptotic peptidase activating  factor 1;
  Uniprot ID:  O14727;
  ENSP ID: ENSP00000448449
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 5901 - protein, 338 aa, Homo sapiens; identical to SEQ ID NO: 5895
  Payload ID: 1289;
  Gene Symbol: APAF1;
  Gene Name: apoptotic peptidase activating  factor 1;
  Uniprot ID:  O14727;
  ENSP ID: ENSP00000448826

SEQ ID NO: 5902 - protein, 1205 aa, Homo sapiens; identical to SEQ ID NO: 5896
  Payload ID: 1289;
  Gene Symbol: APAF1;
  Gene Name: apoptotic peptidase activating  factor 1;
  Uniprot ID:  O14727;
  ENSP ID: ENSP00000449791

SEQ ID NO: 5903 - protein, 130 aa, Homo sapiens
  Payload ID: 1289;
  Gene Symbol: APAF1;
  Gene Name: apoptotic peptidase activating  factor 1;
  ENSP ID: ENSP00000450175
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYGLYPLYLLSLCYQNCFGFVLL

SEQ ID NO: 5904 - protein, 288 aa, Homo sapiens
  Payload ID: 1290;
  Gene Symbol: APTX;
  Gene Name: aprataxin;
  Uniprot ID:  Q7Z2E3;
  ENSP ID: ENSP00000311547
MMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 5905 - protein, 198 aa, Homo sapiens
  Payload ID: 1290;
  Gene Symbol: APTX;
  Gene Name: aprataxin;
  ENSP ID: ENSP00000369140
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMESLGHWSQGLKISMQDPKMQVYKDEQVVVIKDKYPKARYHWLVLPWTSISSLKAVAREHLELLKHMHTVGEKVIVDFAGSSKLRFRLGYHAIPSM

SEQ ID NO: 5906 - protein, 336 aa, Homo sapiens
  Payload ID: 1290;
  Gene Symbol: APTX;
  Gene Name: aprataxin;
  ENSP ID: ENSP00000369141
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 5907 - protein, 342 aa, Homo sapiens
  Payload ID: 1290;
  Gene Symbol: APTX;
  Gene Name: aprataxin;
  Uniprot ID:  Q7Z2E3;
  ENSP ID: ENSP00000369145
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 5908 - protein, 356 aa, Homo sapiens
  Payload ID: 1290;
  Gene Symbol: APTX;
  Gene Name: aprataxin;
  Uniprot ID:  Q7Z2E3;
  ENSP ID: ENSP00000369147
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 5909 - protein, 306 aa, Homo sapiens
  Payload ID: 1290;
  Gene Symbol: APTX;
  Gene Name: aprataxin;
  Uniprot ID:  Q7Z2E3;
  ENSP ID: ENSP00000369153
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQE

SEQ ID NO: 5910 - protein, 284 aa, Homo sapiens
  Payload ID: 1290;
  Gene Symbol: APTX;
  Gene Name: aprataxin;
  Uniprot ID:  Q7Z2E3;
  ENSP ID: ENSP00000380357
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 5911 - protein, 342 aa, Homo sapiens; identical to SEQ ID NO: 5907
  Payload ID: 1290;
  Gene Symbol: APTX;
  Gene Name: aprataxin;
  Uniprot ID:  Q7Z2E3;
  ENSP ID: ENSP00000400806

SEQ ID NO: 5912 - protein, 49 aa, Homo sapiens
  Payload ID: 1290;
  Gene Symbol: APTX;
  Gene Name: aprataxin;
  Uniprot ID:  Q7Z2E3;
  ENSP ID: ENSP00000417634
MMRVCWLVRQDSRHQRIRLPHLEAVVIGRGPETKITDKKCSRQQVESRV

SEQ ID NO: 5913 - protein, 155 aa, Homo sapiens
  Payload ID: 1290;
  Gene Symbol: APTX;
  Gene Name: aprataxin;
  ENSP ID: ENSP00000417649
MMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTS

SEQ ID NO: 5914 - protein, 52 aa, Homo sapiens
  Payload ID: 1290;
  Gene Symbol: APTX;
  Gene Name: aprataxin;
  ENSP ID: ENSP00000417684
MMRVCWLVRQDSRHQRIRLPHLEAVVIGRGPETKITDKKCSRQQGRSQSHQH

SEQ ID NO: 5915 - protein, 74 aa, Homo sapiens
  Payload ID: 1290;
  Gene Symbol: APTX;
  Gene Name: aprataxin;
  ENSP ID: ENSP00000417750
  MOD_RES (1)..(1): Any amino acid
XDFWRVMMRVCWLVRQDSRHQRIRLPHLEAVVIGRGPETKITDKKCSRQQGIPGPLESRLEDFYAGPQNAGLQR

SEQ ID NO: 5916 - protein, 49 aa, Homo sapiens; identical to SEQ ID NO: 5912
  Payload ID: 1290;
  Gene Symbol: APTX;
  Gene Name: aprataxin;
  Uniprot ID:  Q7Z2E3;
  ENSP ID: ENSP00000417804

SEQ ID NO: 5917 - protein, 63 aa, Homo sapiens
  Payload ID: 1290;
  Gene Symbol: APTX;
  Gene Name: aprataxin;
  ENSP ID: ENSP00000418069
MSNVNLSVSDFWRVMMRVCWLVRQDSRHQRIRLPHLEAVVIGRGPETKITDKKCSRQQVESRV

SEQ ID NO: 5918 - protein, 49 aa, Homo sapiens; identical to SEQ ID NO: 5912
  Payload ID: 1290;
  Gene Symbol: APTX;
  Gene Name: aprataxin;
  Uniprot ID:  Q7Z2E3;
  ENSP ID: ENSP00000418144

SEQ ID NO: 5919 - protein, 49 aa, Homo sapiens; identical to SEQ ID NO: 5912
  Payload ID: 1290;
  Gene Symbol: APTX;
  Gene Name: aprataxin;
  Uniprot ID:  Q7Z2E3;
  ENSP ID: ENSP00000418311

SEQ ID NO: 5920 - protein, 49 aa, Homo sapiens; identical to SEQ ID NO: 5912
  Payload ID: 1290;
  Gene Symbol: APTX;
  Gene Name: aprataxin;
  Uniprot ID:  Q7Z2E3;
  ENSP ID: ENSP00000418733

SEQ ID NO: 5921 - protein, 216 aa, Homo sapiens
  Payload ID: 1290;
  Gene Symbol: APTX;
  Gene Name: aprataxin;
  ENSP ID: ENSP00000419020
MSNVNLSVSDFWRVMMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSM

SEQ ID NO: 5922 - protein, 302 aa, Homo sapiens
  Payload ID: 1290;
  Gene Symbol: APTX;
  Gene Name: aprataxin;
  Uniprot ID:  Q7Z2E3;
  ENSP ID: ENSP00000419042
MSNVNLSVSDFWRVMMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 5923 - protein, 192 aa, Homo sapiens
  Payload ID: 1290;
  Gene Symbol: APTX;
  Gene Name: aprataxin;
  Uniprot ID:  Q7Z2E3;
  ENSP ID: ENSP00000419289
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQPCTSSCDQPGF

SEQ ID NO: 5924 - protein, 85 aa, Homo sapiens
  Payload ID: 1290;
  Gene Symbol: APTX;
  Gene Name: aprataxin;
  ENSP ID: ENSP00000419430
MMRVCWLVRQDSRHQRIRLPHLEAVVIGRGPETKITDKKCSRQQVQLKAECNKGYVKVKQSLRKRQRTLAWKHTGRERDQATVIL

SEQ ID NO: 5925 - protein, 99 aa, Homo sapiens
  Payload ID: 1290;
  Gene Symbol: APTX;
  Gene Name: aprataxin;
  ENSP ID: ENSP00000419597
MSNVNLSVSDFWRVMMRVCWLVRQDSRHQRIRLPHLEAVVIGRGPETKITDKKCSRQQVQLKAECNKGYVKVKQSLRKRQRTLAWKHTGRERDQATVIL

SEQ ID NO: 5926 - protein, 49 aa, Homo sapiens; identical to SEQ ID NO: 5912
  Payload ID: 1290;
  Gene Symbol: APTX;
  Gene Name: aprataxin;
  Uniprot ID:  Q7Z2E3;
  ENSP ID: ENSP00000419623

SEQ ID NO: 5927 - protein, 85 aa, Homo sapiens; identical to SEQ ID NO: 5924
  Payload ID: 1290;
  Gene Symbol: APTX;
  Gene Name: aprataxin;
  ENSP ID: ENSP00000419723

SEQ ID NO: 5928 - protein, 342 aa, Homo sapiens; identical to SEQ ID NO: 5907
  Payload ID: 1290;
  Gene Symbol: APTX;
  Gene Name: aprataxin;
  Uniprot ID:  Q7Z2E3;
  ENSP ID: ENSP00000419846

SEQ ID NO: 5929 - protein, 49 aa, Homo sapiens; identical to SEQ ID NO: 5912
  Payload ID: 1290;
  Gene Symbol: APTX;
  Gene Name: aprataxin;
  Uniprot ID:  Q7Z2E3;
  ENSP ID: ENSP00000420071

SEQ ID NO: 5930 - protein, 342 aa, Homo sapiens; identical to SEQ ID NO: 5907
  Payload ID: 1290;
  Gene Symbol: APTX;
  Gene Name: aprataxin;
  Uniprot ID:  Q7Z2E3;
  ENSP ID: ENSP00000420263

SEQ ID NO: 5931 - protein, 511 aa, Homo sapiens
  Payload ID: 1291;
  Gene Symbol: APLF;
  Gene Name: aprataxin and PNKP like factor;
  Uniprot ID:  Q8IW19;
  ENSP ID: ENSP00000307004
MSGGFELQPRDGGPRVALAPGETVIGRGPLLGITDKRVSRRHAILEVAGGQLRIKPIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGNVIQGSGKEEICKDKSQLNTTQQGRRQLISSGSSENTSAEQDTGEECKNTDQEESTISSKEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPVRNVLDEDNDNVGQPNEYDLNDSFLDDEEEDYEPTDEDSDWEPGKEDEEKEDVEELLKEAKRFMKRK

SEQ ID NO: 5932 - protein, 393 aa, Homo sapiens
  Payload ID: 1291;
  Gene Symbol: APLF;
  Gene Name: aprataxin and PNKP like factor;
  ENSP ID: ENSP00000377874
METTMGFMDDNATNTSTSFLSVLNPHGAHATSFPFNFSYSDYDMPLDEDEDVTNSRTFFAAKIVIGMALVGIMLVCGIGNFIFIAALVRYKKLRNLTNLLIANLAISDFLVAIVCCPFEMDYYVVRQLSWEHGHVLCTSVNYLRTVSLYVSTNALLAIAIDRYLAIVHPLRPRMKCQTATGLIALVWTVSILIAIPSAYFTTETVLVIVKSQEKIFCGQIWPVDQQLYYKSYFLFIFGIEFVGPVVTMTLCYARISRELWFKAVPGFQTEQIRKRLRCRRKTVLVLMCILTAYVLCWAPFYGFTIVRDFFPTVFVKEKHYLTAFYIVECIAMSNSMINTLCFVTVKNDTVKYFKKIMLLHWKASYNGGKSSADLDLKTIGMPATEEVDCIRLK

SEQ ID NO: 5933 - protein, 280 aa, Homo sapiens
  Payload ID: 1291;
  Gene Symbol: APLF;
  Gene Name: aprataxin and PNKP like factor;
  ENSP ID: ENSP00000393403
MSGGFELQPRDGGPRVALAPGETVIGRGPLLGITDKRVSRRHAILEVAGGQLRIKPIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGNVIQGSGKEEICKDKSQLNTTQQGRRQLISSGSSENTSAEQDTGEECKNTDQEESTISSKMLIVKNGSIRSI

SEQ ID NO: 5934 - protein, 185 aa, Homo sapiens
  Payload ID: 1291;
  Gene Symbol: APLF;
  Gene Name: aprataxin and PNKP like factor;
  ENSP ID: ENSP00000432297
MSGGFELQPRDGGPRVALAPGETVIGRGPLLGIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGR

SEQ ID NO: 5935 - protein, 269 aa, Homo sapiens
  Payload ID: 1292;
  Gene Symbol: AQP1;
  Gene Name: aquaporin 1 (Colton blood group);
  Uniprot ID:  P29972;
  ENSP ID: ENSP00000311165
MASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 5936 - protein, 154 aa, Homo sapiens
  Payload ID: 1292;
  Gene Symbol: AQP1;
  Gene Name: aquaporin 1 (Colton blood group);
  Uniprot ID:  P29972;
  ENSP ID: ENSP00000386712
MQSGMGWNVLDFWLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 5937 - protein, 218 aa, Homo sapiens
  Payload ID: 1292;
  Gene Symbol: AQP1;
  Gene Name: aquaporin 1 (Colton blood group);
  Uniprot ID:  P29972;
  ENSP ID: ENSP00000387178
MFWTFGYEAVSPAGPSHLFASLLLGVLLTITFMPGARPLPLVLVPQNTLAWMQLDAKAPAHPRPLQLLGRVGPGSRQLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 5938 - protein, 186 aa, Homo sapiens
  Payload ID: 1292;
  Gene Symbol: AQP1;
  Gene Name: aquaporin 1 (Colton blood group);
  Uniprot ID:  P29972;
  ENSP ID: ENSP00000405698
MPGARPLPLVLVPQNTLAWMQLDAKAPAHPRPLQLLGRVGPGSRQLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 5939 - protein, 301 aa, Homo sapiens
  Payload ID: 1293;
  Gene Symbol: AQP10;
  Gene Name: aquaporin 10;
  Uniprot ID:  Q96PS8;
  ENSP ID: ENSP00000318355
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFSAGNGWWWVPVVAPLVGATVGTATYQLLVALHHPEGPEPAQDLVSAQHKASELETPASAQMLECKL

SEQ ID NO: 5940 - protein, 264 aa, Homo sapiens
  Payload ID: 1293;
  Gene Symbol: AQP10;
  Gene Name: aquaporin 10;
  Uniprot ID:  Q96PS8;
  ENSP ID: ENSP00000420341
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFRWETDSPGAGLHSPSSAKGSVPGSTALCL

SEQ ID NO: 5941 - protein, 271 aa, Homo sapiens
  Payload ID: 1294;
  Gene Symbol: AQP11;
  Gene Name: aquaporin 11;
  Uniprot ID:  Q8NBQ7;
  ENSP ID: ENSP00000318770
MSPLLGLRSELQDTCTSLGLMLSVVLLMGLARVVARQQLHRPVAHAFVLEFLATFQLCCCTHELQLLSEQHPAHPTWTLTLVYFFSLVHGLTLVGTSSNPCGVMMQMMLGGMSPETGAVRLLAQLVSALCSRYCTSALWSLGLTQYHVSERSFACKNPIRVDLLKAVITEAVCSFLFHSALLHFQEVRTKLRIHLLAALITFLVYAGGSLTGAVFNPALALSLHFMCFDEAFPQFFIVYWLAPSLGILLMILMFSFFLPWLHNNHTINKKE

SEQ ID NO: 5942 - protein, 295 aa, Homo sapiens
  Payload ID: 1295;
  Gene Symbol: AQP12A;
  Gene Name: aquaporin 12A;
  Uniprot ID:  Q8IXF9;
  ENSP ID: ENSP00000337144
MAGLNVSLSFFFATFALCEAARRASKALLPVGAYEVFAREAMRTLVELGPWAGDFGPDLLLTLLFLLFLAHGVTLDGASANPTVSLQEFLMAEQSLPGTLLKLAAQGLGMQAACTLMRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 5943 - protein, 307 aa, Homo sapiens
  Payload ID: 1295;
  Gene Symbol: AQP12A;
  Gene Name: aquaporin 12A;
  ENSP ID: ENSP00000405899
MAGLNVSLSFFFATFALCEAARRASKALLPVGAYEVFAREAVGAVQLGPCCLEMRTLVELGPWAGDFGPDLLLTLLFLLFLAHGVTLDGASANPTVSLQEFLMAEQSLPGTLLKLAAQGLGMQAACTLMRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 5944 - protein, 307 aa, Homo sapiens
  Payload ID: 1296;
  Gene Symbol: AQP12B;
  Gene Name: aquaporin 12B;
  Uniprot ID:  A6NM10;
  ENSP ID: ENSP00000384894
MAGLNVSLSFFFATFTLCEAARRASKALLPVGAYEVFAREAVGAVQLGACFLEMRTLVELGPWAGDFGPDLLLTLLFLLFLAHGVTLDGASANPTVSLQEFLMAEESLPGTLLKLAAQGLGMQAACTLTRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 5945 - protein, 41 aa, Homo sapiens
  Payload ID: 1296;
  Gene Symbol: AQP12B;
  Gene Name: aquaporin 12B;
  ENSP ID: ENSP00000391528
MAGVPHGRGVSAWHAAEAGGTGAGHAGRLHPDAPLLGLGAQ

SEQ ID NO: 5946 - protein, 41 aa, Homo sapiens; identical to SEQ ID NO: 5945
  Payload ID: 1296;
  Gene Symbol: AQP12B;
  Gene Name: aquaporin 12B;
  ENSP ID: ENSP00000395897

SEQ ID NO: 5947 - protein, 41 aa, Homo sapiens; identical to SEQ ID NO: 5945
  Payload ID: 1296;
  Gene Symbol: AQP12B;
  Gene Name: aquaporin 12B;
  ENSP ID: ENSP00000407457

SEQ ID NO: 5948 - protein, 295 aa, Homo sapiens
  Payload ID: 1296;
  Gene Symbol: AQP12B;
  Gene Name: aquaporin 12B;
  Uniprot ID:  A6NM10;
  ENSP ID: ENSP00000481577
MAGLNVSLSFFFATFTLCEAARRASKALLPVGAYEVFAREAMRTLVELGPWAGDFGPDLLLTLLFLLFLAHGVTLDGASANPTVSLQEFLMAEESLPGTLLKLAAQGLGMQAACTLTRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 5949 - protein, 271 aa, Homo sapiens
  Payload ID: 1297;
  Gene Symbol: AQP2;
  Gene Name: aquaporin 2 (collecting duct);
  Uniprot ID:  P41181;
  ENSP ID: ENSP00000199280
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGIHYTGCSMNPARSLAPAVVTGKFDDHWVFWIGPLVGAILGSLLYNYVLFPPAKSLSERLAVLKGLEPDTDWEEREVRRRQSVELHSPQSLPRGTKA

SEQ ID NO: 5950 - protein, 223 aa, Homo sapiens
  Payload ID: 1297;
  Gene Symbol: AQP2;
  Gene Name: aquaporin 2 (collecting duct);
  ENSP ID: ENSP00000447148
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGIHYTGCSMNPARSLAPAVVTGKFDDHWVFWIGPLVGSPEPGRSPALRL

SEQ ID NO: 5951 - protein, 244 aa, Homo sapiens
  Payload ID: 1297;
  Gene Symbol: AQP2;
  Gene Name: aquaporin 2 (collecting duct);
  ENSP ID: ENSP00000450022
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGVGHGHGFQPPWRNRHTDHSRDRHRDPKRDTYTELSRGTDTPEIHYTGCSMNPARSLAPAVVTGKFDDHW

SEQ ID NO: 5952 - protein, 292 aa, Homo sapiens
  Payload ID: 1298;
  Gene Symbol: AQP3;
  Gene Name: aquaporin 3 (Gill blood group);
  Uniprot ID:  Q92482;
  ENSP ID: ENSP00000297991
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 5953 - protein, 323 aa, Homo sapiens
  Payload ID: 1299;
  Gene Symbol: AQP4;
  Gene Name: aquaporin 4;
  Uniprot ID:  P55087;
  ENSP ID: ENSP00000372654
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 5954 - protein, 98 aa, Homo sapiens
  Payload ID: 1299;
  Gene Symbol: AQP4;
  Gene Name: aquaporin 4;
  ENSP ID: ENSP00000372656
MSDRPTARRWGVDLCVPERTSWWLSKGSGLKLSGKQSQRNFWPCLFLFSSAWDPPSTGVEQKSLYRSTWFSSPFALDSALQPWCSALAISAVATSTLQ

SEQ ID NO: 5955 - protein, 301 aa, Homo sapiens
  Payload ID: 1299;
  Gene Symbol: AQP4;
  Gene Name: aquaporin 4;
  Uniprot ID:  P55087;
  ENSP ID: ENSP00000393121
MVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 5956 - protein, 185 aa, Homo sapiens
  Payload ID: 1299;
  Gene Symbol: AQP4;
  Gene Name: aquaporin 4;
  ENSP ID: ENSP00000462075
MSDRPTARRWGLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGN

SEQ ID NO: 5957 - protein, 301 aa, Homo sapiens; identical to SEQ ID NO: 5955
  Payload ID: 1299;
  Gene Symbol: AQP4;
  Gene Name: aquaporin 4;
  Uniprot ID:  P55087;
  ENSP ID: ENSP00000462597

SEQ ID NO: 5958 - protein, 296 aa, Homo sapiens
  Payload ID: 1299;
  Gene Symbol: AQP4;
  Gene Name: aquaporin 4;
  ENSP ID: ENSP00000484446
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 5959 - protein, 265 aa, Homo sapiens
  Payload ID: 1300;
  Gene Symbol: AQP5;
  Gene Name: aquaporin 5;
  Uniprot ID:  P55064;
  ENSP ID: ENSP00000293599
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNALNNNTTQGQAMVVELILTFQLALCIFASTDSRRTSPVGSPALSIGLSVTLGHLVGIYFTGCSMNPARSFGPAVVMNRFSPAHWVFWVGPIVGAVLAAILYFYLLFPNSLSLSERVAIIKGTYEPDEDWEEQREERKKTMELTTR

SEQ ID NO: 5960 - protein, 282 aa, Homo sapiens
  Payload ID: 1301;
  Gene Symbol: AQP6;
  Gene Name: aquaporin 6, kidney specific;
  Uniprot ID:  Q13520;
  ENSP ID: ENSP00000320247
MDAVEPGGRGWASMLACRLWKAISRALFAEFLATGLYVFFGVGSVMRWPTALPSVLQIAITFNLVTAMAVQVTWKASGAHANPAVTLAFLVGSHISLPRAVAYVAAQLVGATVGAALLYGVMPGDIRETLGINVVRNSVSTGQAVAVELLLTLQLVLCVFASTDSRQTSGSPATMIGISVALGHLIGIHFTGCSMNPARSFGPAIIIGKFTVHWVFWVGPLMGALLASLIYNFVLFPDTKTLAQRLAILTGTVEVGTGAGAGAEPLKKESQPGSGAVEMESV

SEQ ID NO: 5961 - protein, 108 aa, Homo sapiens
  Payload ID: 1301;
  Gene Symbol: AQP6;
  Gene Name: aquaporin 6, kidney specific;
  ENSP ID: ENSP00000449830
MIGISVALGHLIGIHFTGCSMNPARSFGPAIIIGKFTVHWVFWVGPLMGALLASLIYNFVLFPDTKTLAQRLAILTGTVEVGTGAGAGAEPLKKESQPGSGAVEMESV

SEQ ID NO: 5962 - protein, 282 aa, Homo sapiens; identical to SEQ ID NO: 5960
  Payload ID: 1301;
  Gene Symbol: AQP6;
  Gene Name: aquaporin 6, kidney specific;
  Uniprot ID:  Q13520;
  ENSP ID: ENSP00000477688

SEQ ID NO: 5963 - protein, 163 aa, Homo sapiens
  Payload ID: 1301;
  Gene Symbol: AQP6;
  Gene Name: aquaporin 6, kidney specific;
  ENSP ID: ENSP00000477759
MDAVEPGGRGWASMLACRLWKAISRALFAEFLATGLYVFFGVGSVMRWPTALPSVLQIAITFNLVTAMAVQVTWKASGAHANPAVTLAFLVGSHISLPRAVAYVAAQLVGATVGAALLYGVMPGDIRETLGINVAPPTSSALRLFPSSSLHLEACLTRPFSIS

SEQ ID NO: 5964 - protein, 342 aa, Homo sapiens
  Payload ID: 1302;
  Gene Symbol: AQP7;
  Gene Name: aquaporin 7;
  Uniprot ID:  O14520;
  ENSP ID: ENSP00000297988
MVQASGHRRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 5965 - protein, 256 aa, Homo sapiens
  Payload ID: 1302;
  Gene Symbol: AQP7;
  Gene Name: aquaporin 7;
  ENSP ID: ENSP00000368820
MGSGHCLRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 5966 - protein, 341 aa, Homo sapiens
  Payload ID: 1302;
  Gene Symbol: AQP7;
  Gene Name: aquaporin 7;
  ENSP ID: ENSP00000368821
MGSGHCLRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 5967 - protein, 216 aa, Homo sapiens
  Payload ID: 1302;
  Gene Symbol: AQP7;
  Gene Name: aquaporin 7;
  ENSP ID: ENSP00000396111
MVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRWHHLPGLHWLHHPTGAPEIGGFCGV

SEQ ID NO: 5968 - protein, 169 aa, Homo sapiens
  Payload ID: 1302;
  Gene Symbol: AQP7;
  Gene Name: aquaporin 7;
  ENSP ID: ENSP00000410138
MNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAP

SEQ ID NO: 5969 - protein, 165 aa, Homo sapiens
  Payload ID: 1302;
  Gene Symbol: AQP7;
  Gene Name: aquaporin 7;
  Uniprot ID:  O14520;
  ENSP ID: ENSP00000412868
MNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 5970 - protein, 51 aa, Homo sapiens
  Payload ID: 1302;
  Gene Symbol: AQP7;
  Gene Name: aquaporin 7;
  ENSP ID: ENSP00000441619
MVQASGHRRSTRGSKMVSWSVIAKIQEILQRKMVREFLAEFMSTYVMMEPT

SEQ ID NO: 5971 - protein, 80 aa, Homo sapiens
  Payload ID: 1302;
  Gene Symbol: AQP7;
  Gene Name: aquaporin 7;
  ENSP ID: ENSP00000485081
MVQASGHRRSTRGSKMVSWSVIAKIQEILQRKMVREFLAEFMSTYVMMAWLTGMLQLCLFAITDQENNPALPGTEALVIG

SEQ ID NO: 5972 - protein, 41 aa, Homo sapiens
  Payload ID: 1302;
  Gene Symbol: AQP7;
  Gene Name: aquaporin 7;
  ENSP ID: ENSP00000485131
MVQASGHRRGLLAPWIALSAPHPPICKVASLVCHFYWSSPN

SEQ ID NO: 5973 - protein, 51 aa, Homo sapiens; identical to SEQ ID NO: 5970
  Payload ID: 1302;
  Gene Symbol: AQP7;
  Gene Name: aquaporin 7;
  ENSP ID: ENSP00000485224

SEQ ID NO: 5974 - protein, 50 aa, Homo sapiens
  Payload ID: 1302;
  Gene Symbol: AQP7;
  Gene Name: aquaporin 7;
  ENSP ID: ENSP00000485246
MVQASGHRRSTRGSKMVSWSVIAKIQEILQRKMVREFLAEFMSTYVMMRE

SEQ ID NO: 5975 - protein, 257 aa, Homo sapiens
  Payload ID: 1302;
  Gene Symbol: AQP7;
  Gene Name: aquaporin 7;
  ENSP ID: ENSP00000485332
MVQASGHRRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 5976 - protein, 85 aa, Homo sapiens
  Payload ID: 1302;
  Gene Symbol: AQP7;
  Gene Name: aquaporin 7;
  ENSP ID: ENSP00000485348
MVQASGHRRSTRGSKMVSWSVIAKIQEILQRKMVREFLAEFMSTYVMMREGDDWFGVGEESTCLRGLWKTESGRLCQQKMWAKRR

SEQ ID NO: 5977 - protein, 84 aa, Homo sapiens
  Payload ID: 1302;
  Gene Symbol: AQP7;
  Gene Name: aquaporin 7;
  ENSP ID: ENSP00000485419
MGSGHCLRSTRGSKMVSWSVIAKIQEILQRKMVREFLAEFMSTYVMMREGDDWFGVGEESTCLRGLWKTESGRLCQQKMWAKRR

SEQ ID NO: 5978 - protein, 261 aa, Homo sapiens
  Payload ID: 1303;
  Gene Symbol: AQP8;
  Gene Name: aquaporin 8;
  Uniprot ID:  O94778;
  ENSP ID: ENSP00000219660
MSGEIAMCEPEFGNDKAREPSVGGRWRVSWYERFVQPCLVELLGSALFIFIGCLSVIENGTDTGLLQPALAHGLALGLVIATLGNISGGHFNPAVSLAAMLIGGLNLVMLLPYWVSQLLGGMLGAALAKAVSPEERFWNASGAAFVTVQEQGQVAGALVAEIILTTLLALAVCMGAINEKTKGPLAPFSIGFAVTVDILAGGPVSGGCMNPARAFGPAVVANHWNFHWIYWLGPLLAGLLVGLLIRCFIGDGKTRLILKAR

SEQ ID NO: 5979 - protein, 255 aa, Homo sapiens
  Payload ID: 1303;
  Gene Symbol: AQP8;
  Gene Name: aquaporin 8;
  ENSP ID: ENSP00000454457
MCEPEFGNDKAREPSVGGRWRVSWYERFVQPCLVELLGSALFIFIGCLSVIENGTDTGLLQPALAHGLALGLVIATLGNISGGHFNPAVSLAAMLIGGLNLVMLLPYWVSQLLGGMLGAALAKAVSPEERFWNASGAAFVTVQEQGQVAGALVAEIILTTLLALAVCMGAINEKTKGPLAPFSIGFAVTVDILAGGPVSGGCMNPARAFGPAVVANHWNFHWIYWLGPLLAGLLVGLLIRCFIGDGKTRLILKAR

SEQ ID NO: 5980 - protein, 295 aa, Homo sapiens
  Payload ID: 1304;
  Gene Symbol: AQP9;
  Gene Name: aquaporin 9;
  Uniprot ID:  O43315;
  ENSP ID: ENSP00000219919
MQPEGAEKGKSFKQRLVLKSSLAKETLSEFLGTFILIVLGCGCVAQAILSRGRFGGVITINVGFSMAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKTEQSEDKPEKYELSVIM

SEQ ID NO: 5981 - protein, 295 aa, Homo sapiens; identical to SEQ ID NO: 5980
  Payload ID: 1304;
  Gene Symbol: AQP9;
  Gene Name: aquaporin 9;
  Uniprot ID:  O43315;
  ENSP ID: ENSP00000441390

SEQ ID NO: 5982 - protein, 230 aa, Homo sapiens
  Payload ID: 1304;
  Gene Symbol: AQP9;
  Gene Name: aquaporin 9;
  ENSP ID: ENSP00000452673
MAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKTEQSEDKPEKYELSVIM

SEQ ID NO: 5983 - protein, 1485 aa, Homo sapiens
  Payload ID: 1305;
  Gene Symbol: AQR;
  Gene Name: aquarius intron-binding spliceosomal factor;
  Uniprot ID:  O60306;
  ENSP ID: ENSP00000156471
MAAPAQPKKIVAPTVSQINAEFVTQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLDHCFNSLEVDLIRSQVQQLISLPMWMGLQLARLELELKKTPKLRKFWNLIKKNDEKMDPEAREQAYQERRFLSQLIQKFISVLKSVPLSEPVTMDKVHYCERFIELMIDLEALLPTRRWFNTILDDSHLLVHCYLSNLVRREEDGHLFSQLLDMLKFYTGFEINDQTGNALTENEMTTIHYDRITSLQRAAFAHFPELYDFALSNVAEVDTRESLVKFFGPLSSNTLHQVASYLCLLPTLPKNEDTTFDKEFLLELLVSRHERRISQIQQLNQMPLYPTEKIIWDENIVPTEYYSGEGCLALPKLNLQFLTLHDYLLRNFNLFRLESTYEIRQDIEDSVSRMKPWQSEYGGVVFGGWARMAQPIVAFTVVEVAKPNIGENWPTRVRADVTINLNVRDHIKDEWEGLRKHDVCFLITVRPTKPYGTKFDRRRPFIEQVGLVYVRGCEIQGMLDDKGRVIEDGPEPRPNLRGESRTFRVFLDPNQYQQDMTNTIQNGAEDVYETFNIIMRRKPKENNFKAVLETIRNLMNTDCVVPDWLHDIILGYGDPSSAHYSKMPNQIATLDFNDTFLSIEHLKASFPGHNVKVTVEDPALQIPPFRITFPVRSGKGKKRKDADVEDEDTEEAKTLIVEPHVIPNRGPYPYNQPKRNTIQFTHTQIEAIRAGMQPGLTMVVGPPGTGKTDVAVQIISNIYHNFPEQRTLIVTHSNQALNQLFEKIMALDIDERHLLRLGHGEEELETEKDFSRYGRVNYVLARRIELLEEVKRLQKSLGVPGDASYTCETAGYFFLYQVMSRWEEYISKVKNKGSTLPDVTEVSTFFPFHEYFANAPQPIFKGRSYEEDMEIAEGCFRHIKKIFTQLEEFRASELLRSGLDRSKYLLVKEAKIIAMTCTHAALKRHDLVKLGFKYDNILMEEAAQILEIETFIPLLLQNPQDGFSRLKRWIMIGDHHQLPPVIKNMAFQKYSNMEQSLFTRFVRVGVPTVDLDAQGRARASLCNLYNWRYKNLGNLPHVQLLPEFSTANAGLLYDFQLINVEDFQGVGESEPNPYFYQNLGEAEYVVALFMYMCLLGYPADKISILTTYNGQKHLIRDIINRRCGNNPLIGRPNKVTTVDRFQGQQNDYILLSLVRTRAVGHLRDVRRLVVAMSRARLGLYIFARVSLFQNCFELTPAFSQLTARPLHLHIIPTEPFPTTRKNGERPSHEVQIIKNMPQMANFVYNMYMHLIQTTHHYHQTLLQLPPAMVEEGEEVQNQETELETEEEAMTVQADIIPSPTDTSCRQETPAFQTDTTPSETGATSTPEAIPALSETTPTVVGAVSAPAEANTPQDATSAPEETK

SEQ ID NO: 5984 - protein, 646 aa, Homo sapiens
  Payload ID: 1305;
  Gene Symbol: AQR;
  Gene Name: aquarius intron-binding spliceosomal factor;
  ENSP ID: ENSP00000445700
MAAPAQPKKIVAPTVSQINAEFVTQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLDHCFNSLEVDLIRSQVQQLISLPMWMGLQLARLELELKKTPKLRKFWNLIKKNDEKMDPEAREQAYQERRFLSQLIQKFISVLKSVPLSEPVTMDKVHYCERFIELMIDLEALLPTRRWFNTILDDSHLLVHCYLSNLVRREEDGHLFSQLLDMLKFYTGFEINDQTGNALTENEMTTIHYDRITSLQRAAFAHFPELYDFALSNVAEVDTRESLVKFFGPLSSNTLHQVASYLCLLPTLPKNEDTTFDKEFLLELLVSRHERRISQIQQLNQMPLYPTEKIIWDENIVPTEYYSGEGCLALPKLNLQFLTLHDYLLRNFNLFRLESTYEIRQDIEDSVSRMKPWQSEYGGVVFGGWARMAQPIVAFTVVEVAKPNIGENWPTRVRADVTINLNVRDHIKDEWEGLRKHDVCFLITVRPTKPYGTKFDRRRPFIEQVGLVYVRGCEIQGMLDDKGRVIEDGMVTYIFERDLNPDPILEENQGHLECFWIQTSINKI

SEQ ID NO: 5985 - protein, 180 aa, Homo sapiens
  Payload ID: 1305;
  Gene Symbol: AQR;
  Gene Name: aquarius intron-binding spliceosomal factor;
  ENSP ID: ENSP00000453278
MPTGLHACVVPSDILCPPVPSRALLRNRLSLNDLSSSSTMARIWDLLFILFTLQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLD

SEQ ID NO: 5986 - protein, 663 aa, Homo sapiens
  Payload ID: 1306;
  Gene Symbol: ALOX12;
  Gene Name: arachidonate 12-lipoxygenase;
  Uniprot ID:  P18054;
  ENSP ID: ENSP00000251535
MGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELQAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 5987 - protein, 147 aa, Homo sapiens
  Payload ID: 1306;
  Gene Symbol: ALOX12;
  Gene Name: arachidonate 12-lipoxygenase;
  ENSP ID: ENSP00000467033
RWVQGEDILSLPEGTARLPGDNALDMFQKHREKELKDRQQIYCWATWKEGLPLTIAADRKDDLPPNMRFHEEKRLDFEWTLKAGLVLPSGMEELQAQLEKELQNGSLFEADFILLDGIPANVIRGEKQYLAAPLVMLKMEPNGKLQP

SEQ ID NO: 5988 - protein, 701 aa, Homo sapiens
  Payload ID: 1307;
  Gene Symbol: ALOX12B;
  Gene Name: arachidonate 12-lipoxygenase, 12R type;
  Uniprot ID:  O75342;
  ENSP ID: ENSP00000315167
MATYKVRVATGTDLLSGTRDSISLTIVGTQGESHKQLLNHFGRDFATGAVGQYTVQCPQDLGELIIIRLHKERYAFFPKDPWYCNYVQICAPNGRIYHFPAYQWMDGYETLALREATGKTTADDSLPVLLEHRKEEIRAKQDFYHWRVFLPGLPSYVHIPSYRPPVRRHRNPNRPEWNGYIPGFPILINFKATKFLNLNLRYSFLKTASFFVRLGPMALAFKVRGLLDCKHSWKRLKDIRKIFPGKKSVVSEYVAEHWAEDTFFGYQYLNGVNPGLIRRCTRIPDKFPVTDDMVAPFLGEGTCLQAELEKGNIYLADYRIMEGIPTVELSGRKQHHCAPLCLLHFGPEGKMMPIAIQLSQTPGPDCPIFLPSDSEWDWLLAKTWVRYAEFYSHEAIAHLLETHLIAEAFCLALLRNLPMCHPLYKLLIPHTRYTVQINSIGRAVLLNEGGLSAKGMSLGVEGFAGVMVRALSELTYDSLYLPNDFVERGVQDLPGYYYRDDSLAVWNALEKYVTEIITYYYPSDAAVEGDPELQSWVQEIFKECLLGRESSGFPRCLRTVPELIRYVTIVIYTCSAKHAAVNTGQMEFTAWMPNFPASMRNPPIQTKGLTTLETFMDTLPDVKTTCITLLVLWTLSREPDDRRPLGHFPDIHFVEEAPRRSIEAFRQRLNQISHDIRQRNKCLPIPYYYLDPVLIENSISI

SEQ ID NO: 5989 - protein, 662 aa, Homo sapiens
  Payload ID: 1308;
  Gene Symbol: ALOX15;
  Gene Name: arachidonate 15-lipoxygenase;
  Uniprot ID:  P16050;
  ENSP ID: ENSP00000293761
MGLYRIRVSTGASLYAGSNNQVQLWLVGQHGEAALGKRLWPARGKETELKVEVPEYLGPLLFVKLRKRHLLKDDAWFCNWISVQGPGAGDEVRFPCYRWVEGNGVLSLPEGTGRTVGEDPQGLFQKHREEELEERRKLYRWGNWKDGLILNMAGAKLYDLPVDERFLEDKRVDFEVSLAKGLADLAIKDSLNVLTCWKDLDDFNRIFWCGQSKLAERVRDSWKEDALFGYQFLNGANPVVLRRSAHLPARLVFPPGMEELQAQLEKELEGGTLFEADFSLLDGIKANVILCSQQHLAAPLVMLKLQPDGKLLPMVIQLQLPRTGSPPPPLFLPTDPPMAWLLAKCWVRSSDFQLHELQSHLLRGHLMAEVIVVATMRCLPSIHPIFKLIIPHLRYTLEINVRARTGLVSDMGIFDQIMSTGGGGHVQLLKQAGAFLTYSSFCPPDDLADRGLLGVKSSFYAQDALRLWEIIYRYVEGIVSLHYKTDVAVKDDPELQTWCREITEIGLQGAQDRGFPVSLQARDQVCHFVTMCIFTCTGQHASVHLGQLDWYSWVPNAPCTMRLPPPTTKDATLETVMATLPNFHQASLQMSITWQLGRRQPVMVAVGQHEEEYFSGPEPKAVLKKFREELAALDKEIEIRNAKLDMPYEYLRPSVVENSVAI

SEQ ID NO: 5990 - protein, 109 aa, Homo sapiens
  Payload ID: 1308;
  Gene Symbol: ALOX15;
  Gene Name: arachidonate 15-lipoxygenase;
  ENSP ID: ENSP00000458630
MGLYRIRVSTGASLYAGSNNQVQLWLVGQHGEAALGKRLWPARGKETELKVEVPEYLGPLLFVKLRKRHLLKDDAWFCNWISVQGPGAGDEVRFPCYRWVEGNGVLSLP

SEQ ID NO: 5991 - protein, 662 aa, Homo sapiens; identical to SEQ ID NO: 5989
  Payload ID: 1308;
  Gene Symbol: ALOX15;
  Gene Name: arachidonate 15-lipoxygenase;
  Uniprot ID:  P16050;
  ENSP ID: ENSP00000458832

SEQ ID NO: 5992 - protein, 4 aa, Homo sapiens
  Payload ID: 1308;
  Gene Symbol: ALOX15;
  Gene Name: arachidonate 15-lipoxygenase;
  ENSP ID: ENSP00000460430
MAGA

SEQ ID NO: 5993 - protein, 623 aa, Homo sapiens
  Payload ID: 1308;
  Gene Symbol: ALOX15;
  Gene Name: arachidonate 15-lipoxygenase;
  Uniprot ID:  P16050;
  ENSP ID: ENSP00000460483
MGLYRIRVSTGASLYAGSNNQVQLWLVGQHGEAALGKRLWPARGKGPGAGDEVRFPCYRWVEGNGVLSLPEGTGRTVGEDPQGLFQKHREEELEERRKLYRWGNWKDGLILNMAGAKLYDLPVDERFLEDKRVDFEVSLAKGLADLAIKDSLNVLTCWKDLDDFNRIFWCGQSKLAERVRDSWKEDALFGYQFLNGANPVVLRRSAHLPARLVFPPGMEELQAQLEKELEGGTLFEADFSLLDGIKANVILCSQQHLAAPLVMLKLQPDGKLLPMVIQLQLPRTGSPPPPLFLPTDPPMAWLLAKCWVRSSDFQLHELQSHLLRGHLMAEVIVVATMRCLPSIHPIFKLIIPHLRYTLEINVRARTGLVSDMGIFDQIMSTGGGGHVQLLKQAGAFLTYSSFCPPDDLADRGLLGVKSSFYAQDALRLWEIIYRYVEGIVSLHYKTDVAVKDDPELQTWCREITEIGLQGAQDRGFPVSLQARDQVCHFVTMCIFTCTGQHASVHLGQLDWYSWVPNAPCTMRLPPPTTKDATLETVMATLPNFHQASLQMSITWQLGRRQPVMVAVGQHEEEYFSGPEPKAVLKKFREELAALDKEIEIRNAKLDMPYEYLRPSVVENSVAI

SEQ ID NO: 5994 - protein, 647 aa, Homo sapiens
  Payload ID: 1309;
  Gene Symbol: ALOX15B;
  Gene Name: arachidonate 15-lipoxygenase, type B;
  Uniprot ID:  O15296;
  ENSP ID: ENSP00000369520
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASVLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKSTGIGIEGFSELIQRNMKQLNYSLLCLPEDIRTRGVEDIPGYYYRDDGMQIWGAVERFVSEIIGIYYPSDESVQDDRELQAWVREIFSKGFLNQESSGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNQGLVLPYTYLDPPLIENSVSI

SEQ ID NO: 5995 - protein, 676 aa, Homo sapiens
  Payload ID: 1309;
  Gene Symbol: ALOX15B;
  Gene Name: arachidonate 15-lipoxygenase, type B;
  Uniprot ID:  O15296;
  ENSP ID: ENSP00000369530
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASVLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKLLIPHTRYTLHINTLARELLIVPGQVVDRSTGIGIEGFSELIQRNMKQLNYSLLCLPEDIRTRGVEDIPGYYYRDDGMQIWGAVERFVSEIIGIYYPSDESVQDDRELQAWVREIFSKGFLNQESSGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNQGLVLPYTYLDPPLIENSVSI

SEQ ID NO: 5996 - protein, 664 aa, Homo sapiens
  Payload ID: 1309;
  Gene Symbol: ALOX15B;
  Gene Name: arachidonate 15-lipoxygenase, type B;
  ENSP ID: ENSP00000458749
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASVLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKLLIPHTRYTLHINTLARELLIVPGQVVDRSTGIGIEGFSELIQRNMKQLNYSLLCLPEDIRTRGVEDIPGYYYRDDGMQIWGAVERDESVQDDRELQAWVREIFSKGFLNQESSGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNQGLVLPYTYLDPPLIENSVSI

SEQ ID NO: 5997 - protein, 602 aa, Homo sapiens
  Payload ID: 1309;
  Gene Symbol: ALOX15B;
  Gene Name: arachidonate 15-lipoxygenase, type B;
  Uniprot ID:  O15296;
  ENSP ID: ENSP00000460332
MAEFRVRVSTGEAFGAGTWDKVSVSIVGTRGESPPLPLDNLGKEFTAGAEEDFQVTLPEDVGRVLLLRVHKAPPVLPLLGPLAPDAWFCRWFQLTPPRGGHLLFPCYQWLEGAGTLVLQEGTAKVSWADHHPVLQQQRQEELQARQEMYQWKAYNPGWPHCLDEKTVEDLELNIKYSTAKNANFYLQAGSAFAEMKIKGLLDRKGLWRSLNEMKRIFNFRRTPAAEHAFEHWQEDAFFASQFLNGLNPVLIRRCHYLPKNFPVTDAMVASVLGPGTSLQAELEKGSLFLVDHGILSGIQTNVINGKPQFSAAPMTLLYQSPGCGPLLPLAIQLSQTPGPNSPIFLPTDDKWDWLLAKTWVRNAEFSFHEALTHLLHSHLLPEVFTLATLRQLPHCHPLFKSTGIGIEGFSELIQRNMKQLNYSLLCLPEDIRTRGVEDIPGYYYRDDGMQIWGIPSSLETREALVQYVTMVIFTCSAKHAAVSAGQFDSCAWMPNLPPSMQLPPPTSKGLATCEGFIATLPPVNATCDVILALWLLSKEPGDQRPLGTYPDEHFTEEAPRRSIATFQSRLAQISRGIQERNQGLVLPYTYLDPPLIENSVSI

SEQ ID NO: 5998 - protein, 674 aa, Homo sapiens
  Payload ID: 1310;
  Gene Symbol: ALOX5;
  Gene Name: arachidonate 5-lipoxygenase;
  Uniprot ID:  P09917;
  ENSP ID: ENSP00000363512
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 5999 - protein, 617 aa, Homo sapiens
  Payload ID: 1310;
  Gene Symbol: ALOX5;
  Gene Name: arachidonate 5-lipoxygenase;
  Uniprot ID:  P09917;
  ENSP ID: ENSP00000437634
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQLFLGMYPEEHFIEKPVKEAMARFRKNLEAIVSVIAERNKKKQLPYYYLSPDRIPNSVAI

SEQ ID NO: 6000 - protein, 139 aa, Homo sapiens
  Payload ID: 1310;
  Gene Symbol: ALOX5;
  Gene Name: arachidonate 5-lipoxygenase;
  ENSP ID: ENSP00000479452
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGREMDGVEPWLPLEHRCQMPQGFTP

SEQ ID NO: 6001 - protein, 617 aa, Homo sapiens; identical to SEQ ID NO: 5999
  Payload ID: 1310;
  Gene Symbol: ALOX5;
  Gene Name: arachidonate 5-lipoxygenase;
  Uniprot ID:  P09917;
  ENSP ID: ENSP00000479958

SEQ ID NO: 6002 - protein, 139 aa, Homo sapiens; identical to SEQ ID NO: 6000
  Payload ID: 1310;
  Gene Symbol: ALOX5;
  Gene Name: arachidonate 5-lipoxygenase;
  ENSP ID: ENSP00000483803

SEQ ID NO: 6003 - protein, 674 aa, Homo sapiens; identical to SEQ ID NO: 5998
  Payload ID: 1310;
  Gene Symbol: ALOX5;
  Gene Name: arachidonate 5-lipoxygenase;
  Uniprot ID:  P09917;
  ENSP ID: ENSP00000484468

SEQ ID NO: 6004 - protein, 161 aa, Homo sapiens
  Payload ID: 1311;
  Gene Symbol: ALOX5AP;
  Gene Name: arachidonate 5-lipoxygenase-activating prt;
  Uniprot ID:  P20292;
  ENSP ID: ENSP00000369858
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFENYIKTISTTISPLLLIP

SEQ ID NO: 6005 - protein, 218 aa, Homo sapiens
  Payload ID: 1311;
  Gene Symbol: ALOX5AP;
  Gene Name: arachidonate 5-lipoxygenase-activating prt;
  ENSP ID: ENSP00000479870
MLTFNHDAPWHTQKTLKTSEFGKSFGTLGHIGNISHQCWAGCAAGGRAVLSGEPEANMDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFENYIKTISTTISPLLLIP

SEQ ID NO: 6006 - protein, 843 aa, Homo sapiens
  Payload ID: 1312;
  Gene Symbol: ALOXE3;
  Gene Name: arachidonate lipoxygenase 3;
  Uniprot ID:  Q9BYJ1;
  ENSP ID: ENSP00000314879
MPRGAFRPCLPALYFAFLTCPTPEQRMSGTQAPDIHLGEPARGTGCVRGKQTSIRVQDCGRREEARAASRELRREKAQEHPRESWAHPQPYPAPQPLALRPETQPCPACRSSPPGRLLLRPALPGHPFLLPIMAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPCMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQHDFGAWMPNAPSSMRQPPPQTKGTTTLKTYLDTLPEVNISCNNLLLFWLVSQEPKDQRPLGTYPDEHFTEEAPRRSIAAFQSRLAQISRDIQERNQGLALPYTYLDPPLIENSVSI

SEQ ID NO: 6007 - protein, 867 aa, Homo sapiens
  Payload ID: 1312;
  Gene Symbol: ALOXE3;
  Gene Name: arachidonate lipoxygenase 3;
  ENSP ID: ENSP00000369494
MGRNRSWGTLGSGRTSTPGHQSGPLTRRRAVSQLYRRYLLFSISASDPSLRSGTQAPDIHLGEPARGTGCVRGKQTSIRVQDCGRREEARAASRELRREKAQEHPRESWAHPQPYPAPQPLALRPETQPCPACRSSPPGRLLLRPALPGHPFLLPIMAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPCMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQHDFGAWMPNAPSSMRQPPPQTKGTTTLKTYLDTLPEVNISCNNLLLFWLVSQEPKDQRPLGTYPDEHFTEEAPRRSIAAFQSRLAQISRDIQERNQGLALPYTYLDPPLIENSVSI

SEQ ID NO: 6008 - protein, 711 aa, Homo sapiens
  Payload ID: 1312;
  Gene Symbol: ALOXE3;
  Gene Name: arachidonate lipoxygenase 3;
  Uniprot ID:  Q9BYJ1;
  ENSP ID: ENSP00000400581
MAVYRLCVTTGPYLRAGTLDNISVTLVGTCGESPKQRLDRMGRDFAPGSVQKYKVRCTAELGELLLLRVHKERYAFFRKDSWYCSRICVTEPDGSVSHFPCYQWIEGYCTVELRPGTARTICQDSLPLLLDHRTRELRARQECYRWKIYAPGFPCMVDVNSFQEMESDKKFALTKTTTCVDQGDSSGNRYLPGFPMKIDIPSLMYMEPNVRYSATKTISLLFNAIPASLGMKLRGLLDRKGSWKKLDDMQNIFWCHKTFTTKYVTEHWCEDHFFGYQYLNGVNPVMLHCISSLPSKLPVTNDMVAPLLGQDTCLQTELERGNIFLADYWILAEAPTHCLNGRQQYVAAPLCLLWLSPQGALVPLAIQLSQTPGPDSPIFLPTDSEWDWLLAKTWVRNSEFLVHENNTHFLCTHLLCEAFAMATLRQLPLCHPIYKLLLPHTRYTLQVNTIARATLLNPEGLVDQVTSIGRQGLIYLMSTGLAHFTYTNFCLPDSLRARGVLAIPNYHYRDDGLKIWAAIESFVSEIVGYYYPSDASVQQDSELQAWTGEIFAQAFLGRESSGFPSRLCTPGEMVKFLTAIIFNCSAQHAAVNSGQHDFGAWMPNAPSSMRQPPPQTKGTTTLKTYLDTLPEVNISCNNLLLFWLVSQEPKDQRPLGTYPDEHFTEEAPRRSIAAFQSRLAQISRDIQERNQGLALPYTYLDPPLIENSVSI

SEQ ID NO: 6009 - protein, 609 aa, Homo sapiens
  Payload ID: 1313;
  Gene Symbol: ARAF;
  Gene Name: A-Raf proto-oncogene, serine/threonine kinase;
  ENSP ID: ENSP00000290277
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQPSRFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQILATIELLQRSLPKIERSASEPSLHRTQADELPACLLSAARLVP

SEQ ID NO: 6010 - protein, 186 aa, Homo sapiens
  Payload ID: 1313;
  Gene Symbol: ARAF;
  Gene Name: A-Raf proto-oncogene, serine/threonine kinase;
  Uniprot ID:  P10398;
  ENSP ID: ENSP00000366238
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPR

SEQ ID NO: 6011 - protein, 606 aa, Homo sapiens [sequence omitted]

SEQ ID NO: 6012 - protein, 252 aa, Homo sapiens
  Payload ID: 1314;
  Gene Symbol: AANAT;
  Gene Name: aralkylamine N-acetyltransferase;
  Uniprot ID:  Q16613;
  ENSP ID: ENSP00000250615
MEPQSMKGQKRPFGGPWRLKVLGGPPWLRRTLPKLGRPKEAPVARMSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 6013 - protein, 207 aa, Homo sapiens
  Payload ID: 1314;
  Gene Symbol: AANAT;
  Gene Name: aralkylamine N-acetyltransferase;
  Uniprot ID:  Q16613;
  ENSP ID: ENSP00000376282
MSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 6014 - protein, 92 aa, Homo sapiens
  Payload ID: 1314;
  Gene Symbol: AANAT;
  Gene Name: aralkylamine N-acetyltransferase;
  ENSP ID: ENSP00000468239
MSTQSTHPLKPEAPRLPPGIPESPSCQRRHTLPASEFRCLTPEDAVSAFEIEREDSGREAQRLPVTHLSLLPQPSSPSWASAPCTWMRSGTS

SEQ ID NO: 6015 - protein, 151 aa, Homo sapiens
  Payload ID: 1314;
  Gene Symbol: AANAT;
  Gene Name: aralkylamine N-acetyltransferase;
  ENSP ID: ENSP00000468717
MRMRPLSLAVLQQVLGGPPWLRRTLPKLGRPKEAPVARMSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHR

SEQ ID NO: 6016 - protein, 498 aa, Homo sapiens
  Payload ID: 1315;
  Gene Symbol: AMZ1;
  Gene Name: archaelysin family metallopeptidase 1;
  Uniprot ID:  Q400G9;
  ENSP ID: ENSP00000308149
MLQCRPAQEFSFGPRALKDALVSTDAALQQLYVSAFSPAERLFLAEAYNPQRTLFCTLLIRTGFDWLLSRPEAPEDFQTFHASLQHRKPRLARKHIYLQPIDLSEEPVGSSLLHQLCSCTEAFFLGLRVKCLPSVAAASIRCSSRPSRDSDRLQLHTDGILSFLKNNKPGDALCVLGLTLSDLYPHEAWSFTFSKFLPGHEVGVCSFARFSGEFPKSGPSAPDLALVEAAADGPEAPLQDRGWALCFSALGMVQCCKVTCHELCHLLGLGNCRWLRCLMQGALSLDEALRRPLDLCPICLRKLQHVLGFRLIERYQRLYTWTQAVVGTWPSQEAGEPSVWEDTPPASADSGMCCESDSEPGTSVSEPLTPDAGSHTFASGPEEGLSYLAASEAPLPPGGPAEAIKEHERWLAMCIQALQREVAEEDLVQVDRAVDALDRWEMFTGQLPATRQDPPSSRDSVGLRKVLGDKFSSLRRKLSARKLARAESAPRPWDGEES

SEQ ID NO: 6017 - protein, 297 aa, Homo sapiens
  Payload ID: 1315;
  Gene Symbol: AMZ1;
  Gene Name: archaelysin family metallopeptidase 1;
  Uniprot ID:  Q400G9;
  ENSP ID: ENSP00000386020
MLQCRPAQEFSFGPRALKDALVSTDAALQQLYVSAFSPAERLFLAEAYNPQRTLFCTLLIRTGFDWLLSRPEAPEDFQTFHASLQHRKPRLARKHIYLQPIDLSEEPVGSSLLHQLCSCTEAFFLGLRVKCLPSVAAASIRCSSRPSRDSDRLQLHTDGILSFLKNNKPGDALCVLGLTLSDLYPHEAWSFTFSKFLPGHGHVPRALPPSGPGELPLAPLPHAGCAQPGRGPAAAPGPLSHLPEEAAACPGFQAHREVPETLHLDSGGGGDVAQPGGGGAVSVGGHPACQRRLGHVL

SEQ ID NO: 6018 - protein, 302 aa, Homo sapiens
  Payload ID: 1316;
  Gene Symbol: AMZ2;
  Gene Name: archaelysin family metallopeptidase 2;
  Uniprot ID:  Q86W34;
  ENSP ID: ENSP00000352831
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 6019 - protein, 360 aa, Homo sapiens
  Payload ID: 1316;
  Gene Symbol: AMZ2;
  Gene Name: archaelysin family metallopeptidase 2;
  Uniprot ID:  Q86W34;
  ENSP ID: ENSP00000352976
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSCKTLTHEIGHIFGLRHCQWLACLMQGSNHLEEADRRPLNLCPICLHKLQCAVGFSIVERYKALVRWIDDESSDTPGATPEHSHEDNGNLPKPVEAFKEWKEWIIKCLAVLQK

SEQ ID NO: 6020 - protein, 360 aa, Homo sapiens; identical to SEQ ID NO: 6019
  Payload ID: 1316;
  Gene Symbol: AMZ2;
  Gene Name: archaelysin family metallopeptidase 2;
  Uniprot ID:  Q86W34;
  ENSP ID: ENSP00000376481

SEQ ID NO: 6021 - protein, 248 aa, Homo sapiens
  Payload ID: 1316;
  Gene Symbol: AMZ2;
  Gene Name: archaelysin family metallopeptidase 2;
  ENSP ID: ENSP00000461935
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRS

SEQ ID NO: 6022 - protein, 201 aa, Homo sapiens
  Payload ID: 1316;
  Gene Symbol: AMZ2;
  Gene Name: archaelysin family metallopeptidase 2;
  ENSP ID: ENSP00000462140
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGTGEVD

SEQ ID NO: 6023 - protein, 197 aa, Homo sapiens
  Payload ID: 1316;
  Gene Symbol: AMZ2;
  Gene Name: archaelysin family metallopeptidase 2;
  ENSP ID: ENSP00000462292
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGV

SEQ ID NO: 6024 - protein, 195 aa, Homo sapiens
  Payload ID: 1316;
  Gene Symbol: AMZ2;
  Gene Name: archaelysin family metallopeptidase 2;
  ENSP ID: ENSP00000462484
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTD

SEQ ID NO: 6025 - protein, 360 aa, Homo sapiens; identical to SEQ ID NO: 6019
  Payload ID: 1316;
  Gene Symbol: AMZ2;
  Gene Name: archaelysin family metallopeptidase 2;
  Uniprot ID:  Q86W34;
  ENSP ID: ENSP00000463012

SEQ ID NO: 6026 - protein, 221 aa, Homo sapiens
  Payload ID: 1316;
  Gene Symbol: AMZ2;
  Gene Name: archaelysin family metallopeptidase 2;
  ENSP ID: ENSP00000463053
MRVRAAAARPRHVRPCKLKASMGAFLPNQDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYGSDFYSMHYKGKVKKLKKTSSSDYSIFDNYYIPEITSVLLLRSC

SEQ ID NO: 6027 - protein, 76 aa, Homo sapiens
  Payload ID: 1316;
  Gene Symbol: AMZ2;
  Gene Name: archaelysin family metallopeptidase 2;
  ENSP ID: ENSP00000463344
  MOD_RES (1)..(1): Any amino acid
XEQRLMNEAFQPASDLFGPITLHSPSDWITSHPEAPQDFEQFFSDPYRKTPSPNKRSIYIQSIGKYWLSRKHQNYQ

SEQ ID NO: 6028 - protein, 206 aa, Homo sapiens
  Payload ID: 1316;
  Gene Symbol: AMZ2;
  Gene Name: archaelysin family metallopeptidase 2;
  ENSP ID: ENSP00000463596
MQIIRHSEQTLKTALISKNPVLVSQYEKLNAGEQRLMNEAFQPASDLFGPITLHSPSDWITSHPEAPQDFEQFFSDPYRKTPSPNKRSIYIQSIGSLGNTRIISEEYIKWLTGYCKAYFYGLRVKLLEPVPVSVTRCSFRVNENTHNLQIHAGDILKFLKKKKPEDAFCVVGITMIDLYPRDSWNFVFGQASLTDGVGIFSFARYG

SEQ ID NO: 6029 - protein, 23 aa, Homo sapiens
  Payload ID: 1316;
  Gene Symbol: AMZ2;
  Gene Name: archaelysin family metallopeptidase 2;
  ENSP ID: ENSP00000463857
RSIYIQSIGKYWGHPEVLEKEET

SEQ ID NO: 6030 - protein, 360 aa, Homo sapiens; identical to SEQ ID NO: 6019
  Payload ID: 1316;
  Gene Symbol: AMZ2;
  Gene Name: archaelysin family metallopeptidase 2;
  Uniprot ID:  Q86W34;
  ENSP ID: ENSP00000464133

SEQ ID NO: 6031 - protein, 360 aa, Homo sapiens; identical to SEQ ID NO: 6019
  Payload ID: 1316;
  Gene Symbol: AMZ2;
  Gene Name: archaelysin family metallopeptidase 2;
  Uniprot ID:  Q86W34;
  ENSP ID: ENSP00000464635

SEQ ID NO: 6032 - protein, 360 aa, Homo sapiens; identical to SEQ ID NO: 6019
  Payload ID: 1316;
  Gene Symbol: AMZ2;
  Gene Name: archaelysin family metallopeptidase 2;
  Uniprot ID:  Q86W34;
  ENSP ID: ENSP00000483162

SEQ ID NO: 6033 - protein, 511 aa, Homo sapiens
  Payload ID: 1317;
  Gene Symbol: ARCN1;
  Gene Name: archain 1;
  Uniprot ID:  P48444;
  ENSP ID: ENSP00000264028
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 6034 - protein, 552 aa, Homo sapiens
  Payload ID: 1317;
  Gene Symbol: ARCN1;
  Gene Name: archain 1;
  ENSP ID: ENSP00000352385
MAECNLVAILISSIDNPLDKNLDNGGNSCLDFRPLNSFSQPQVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 6035 - protein, 423 aa, Homo sapiens
  Payload ID: 1317;
  Gene Symbol: ARCN1;
  Gene Name: archain 1;
  Uniprot ID:  P48444;
  ENSP ID: ENSP00000376599
MIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 6036 - protein, 83 aa, Homo sapiens
  Payload ID: 1317;
  Gene Symbol: ARCN1;
  Gene Name: archain 1;
  ENSP ID: ENSP00000431676
MVLLAAAVCTKAGKAIVSRQFVEMTRTRIEGLLAAFPKLMNTGKQHTFVETESIRMSSVLFPYQFIPSSLCQVVFLSGPVLPV

SEQ ID NO: 6037 - protein, 189 aa, Homo sapiens
  Payload ID: 1317;
  Gene Symbol: ARCN1;
  Gene Name: archain 1;
  ENSP ID: ENSP00000482114
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQAQSVGITGMSHHAQLLLYFNP

SEQ ID NO: 6038 - protein, 740 aa, Homo sapiens
  Payload ID: 1318;
  Gene Symbol: ACAP1;
  Gene Name: ArfGAP with coiled-coil, ankyrin repeat and PH domains 1;
  Uniprot ID:  Q15027;
  ENSP ID: ENSP00000158762
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSIASAFSQARLDDSPRGPGQGSGHLAIGSAATLGSGGMARGREPGGVGHVVAQVQSVDGNAQCCDCREPAPEWASINLGVTLCIQCSGIHRSLGVHFSKVRSLTLDSWEPELVKLMCELGNVIINQIYEARVEAMAVKKPGPSCSRQEKEAWIHAKYVEKKFLTKLPEIRGRRGGRGRPRGQPPVPPKPSIRPRPGSLRSKPEPPSEDLGSLHPGALLFRASGHPPSLPTMADALAHGADVNWVNGGQDNATPLIQATAANSLLACEFLLQNGANVNQADSAGRGPLHHATILGHTGLACLFLKRGADLGARDSEGRDPLTIAMETANADIVTLLRLAKMREAEAAQGQAGDETYLDIFRDFSLMASDDPEKLSRRSHDLHTL

SEQ ID NO: 6039 - protein, 148 aa, Homo sapiens
  Payload ID: 1318;
  Gene Symbol: ACAP1;
  Gene Name: ArfGAP with coiled-coil, ankyrin repeat and PH domains 1;
  ENSP ID: ENSP00000458173
MMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGA

SEQ ID NO: 6040 - protein, 101 aa, Homo sapiens
  Payload ID: 1318;
  Gene Symbol: ACAP1;
  Gene Name: ArfGAP with coiled-coil, ankyrin repeat and PH domains 1;
  ENSP ID: ENSP00000459422
MMAECLEKFTVSLNHKLDSHAELLDATQHTLQQQIQTLVKEGLRGFREARRDFWRGAESLEAALTHNAEVPRRRAQEAEEAGAALRTARAGYRGRALDYAL

SEQ ID NO: 6041 - protein, 44 aa, Homo sapiens
  Payload ID: 1318;
  Gene Symbol: ACAP1;
  Gene Name: ArfGAP with coiled-coil, ankyrin repeat and PH domains 1;
  ENSP ID: ENSP00000460054
MREAEAAQGQAGDETYLDIFRDFSLMASDDPEKLSRRSHDLHTL

SEQ ID NO: 6042 - protein, 44 aa, Homo sapiens; identical to SEQ ID NO: 6041
  Payload ID: 1318;
  Gene Symbol: ACAP1;
  Gene Name: ArfGAP with coiled-coil, ankyrin repeat and PH domains 1;
  ENSP ID: ENSP00000460735

SEQ ID NO: 6043 - protein, 65 aa, Homo sapiens
  Payload ID: 1318;
  Gene Symbol: ACAP1;
  Gene Name: ArfGAP with coiled-coil, ankyrin repeat and PH domains 1;
  ENSP ID: ENSP00000460803
MNGTQPSSKDGKLWGRLRLAKMREAEAAQGQAGDETYLDIFRDFSLMASDDPEKLSRRSHDLHTL

SEQ ID NO: 6044 - protein, 44 aa, Homo sapiens; identical to SEQ ID NO: 6041
  Payload ID: 1318;
  Gene Symbol: ACAP1;
  Gene Name: ArfGAP with coiled-coil, ankyrin repeat and PH domains 1;
  ENSP ID: ENSP00000461314

SEQ ID NO: 6045 - protein, 778 aa, Homo sapiens
  Payload ID: 1319;
  Gene Symbol: ACAP2;
  Gene Name: ArfGAP with coiled-coil, ankyrin repeat and PH domains 2;
  Uniprot ID:  Q15057;
  ENSP ID: ENSP00000324287
MKMTVDFEECLKDSPRFRAALEEVEGDVAELELKLDKLVKLCIAMIDTGKAFCVANKQFMNGIRDLAQYSSNDAVVETSLTKFSDSLQEMINFHTILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVRSNDSGIQQSSDDGRESLPSTVSANSLYEPEGERQDSSMFLDSKHLNPGLQLYRASYEKNLPKMAEALAHGADVNWANSEENKATPLIQAVLGGSLVTCEFLLQNGANVNQRDVQGRGPLHHATVLGHTGQVCLFLKRGANQHATDEEGKDPLSIAVEAANADIVTLLRLARMNEEMRESEGLYGQPGDETYQDIFRDFSQMASNNPEKLNRFQQDSQKF

SEQ ID NO: 6046 - protein, 49 aa, Homo sapiens
  Payload ID: 1319;
  Gene Symbol: ACAP2;
  Gene Name: ArfGAP with coiled-coil, ankyrin repeat and PH domains 2;
  ENSP ID: ENSP00000405262
MKMTVDFEECLKDSPRFRCRESRGLFYRLLFPKSLVQCVTSILELGSPR

SEQ ID NO: 6047 - protein, 51 aa, Homo sapiens
  Payload ID: 1319;
  Gene Symbol: ACAP2;
  Gene Name: ArfGAP with coiled-coil, ankyrin repeat and PH domains 2;
  ENSP ID: ENSP00000411336
MIDTGKAFCVANKQFMNGIRDLAQYSSNDAVVETSLTKFSDSLQEMINFHT

SEQ ID NO: 6048 - protein, 228 aa, Homo sapiens
  Payload ID: 1319;
  Gene Symbol: ACAP2;
  Gene Name: ArfGAP with coiled-coil, ankyrin repeat and PH domains 2;
  ENSP ID: ENSP00000412338
  MOD_RES (1)..(1): Any amino acid
XSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLSISKFGPGDQVRASAQSSVIAVNSDEARRESLFCPDELDSLFSYFDTSSKLRSIRSNDSGIQQSSDDGRESLPSTVSANSLYEPEGERQDSSMFLDSKHLNPGLQLYRASYEKNLPKMAEALAHGADVNW

SEQ ID NO: 6049 - protein, 256 aa, Homo sapiens
  Payload ID: 1319;
  Gene Symbol: ACAP2;
  Gene Name: ArfGAP with coiled-coil, ankyrin repeat and PH domains 2;
  ENSP ID: ENSP00000413388
  MOD_RES (1)..(1): Any amino acid
XSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKAALQDFSSDDSKLEYNVDAANGIVMEGYLFKRASNAFKTWNRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPS

SEQ ID NO: 6050 - protein, 777 aa, Homo sapiens [sequence omitted]

SEQ ID NO: 6051 - protein, 547 aa, Homo sapiens
  Payload ID: 1319;
  Gene Symbol: ACAP2;
  Gene Name: ArfGAP with coiled-coil, ankyrin repeat and PH domains 2;
  ENSP ID: ENSP00000489156
MKMTVDFEECLKDSPRFRAALEEVEGDVAELELKLDKLVKLCIAMIDTGKAFCVANKQFMNGIRDLAQYSSNDAVVETSLTKFSDSLQEMINFHTILFDQTQRSIKAQLQNFVKEDLRKFKDAKKQFEKVSEEKENALVKNAQVQRNKQHEVEEATNILTATRKCFRHIALDYVLQINVLQSKRRSEILKSMLSFMYAHLAFFHQGYDLFSELGPYMKDLGAQLDRLVVDAAKEKREMEQKHSTIQQKDFSSDDSKLEYNVDAANGIVMEGYLFKRASNAFKTWNRKKPDHIRRWFSIQNNQLVYQKKFKDNPTVVVEDLRLCTVKHCEDIERRFCFEVVSPTKSCMLQADSEKLRQAWIKAVQTSIATAYREKGDESEKLDKKSSPSTGSLDSGNESKEKLLKGESALQRVQCIPGNASCCDCGLADPRWASINLGITLCIECSGIHRSLGVHFSKVRSLTLDTWEPELLKLMCELGNDVINRVYEANVEKMGIKKPQPGQRQEKEAYIRAKYVERKFVDKYSISLSPPEQQKKFVSKSSEEKRLS

SEQ ID NO: 6052 - protein, 759 aa, Homo sapiens
  Payload ID: 1320;
  Gene Symbol: ACAP3;
  Gene Name: ArfGAP with coiled-coil, ankyrin repeat and PH domains 3;
  Uniprot ID:  Q96P50;
  ENSP ID: ENSP00000321139
MVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRKGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 6053 - protein, 834 aa, Homo sapiens
  Payload ID: 1320;
  Gene Symbol: ACAP3;
  Gene Name: ArfGAP with coiled-coil, ankyrin repeat and PH domains 3;
  Uniprot ID:  Q96P50;
  ENSP ID: ENSP00000346733
MTVEFEECVKDSPRFRATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEEGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 6054 - protein, 52 aa, Homo sapiens
  Payload ID: 1320;
  Gene Symbol: ACAP3;
  Gene Name: ArfGAP with coiled-coil, ankyrin repeat and PH domains 3;
  ENSP ID: ENSP00000347075
MTVEFEECVKDSPRFRAARGEQAAGAAFKAWGRPLTRWRRTWWRLRPNWTSW

SEQ ID NO: 6055 - protein, 374 aa, Homo sapiens
  Payload ID: 1321;
  Gene Symbol: ADAP1;
  Gene Name: ArfGAP with dual PH domains 1;
  Uniprot ID:  O75689;
  ENSP ID: ENSP00000265846
MAKERRRAVLELLQRPGNARCADCGAPDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 6056 - protein, 192 aa, Homo sapiens
  Payload ID: 1321;
  Gene Symbol: ADAP1;
  Gene Name: ArfGAP with dual PH domains 1;
  ENSP ID: ENSP00000391315
  MOD_RES (1)..(1): Any amino acid
XCRVQPLCEQLQFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSR

SEQ ID NO: 6057 - protein, 162 aa, Homo sapiens
  Payload ID: 1321;
  Gene Symbol: ADAP1;
  Gene Name: ArfGAP with dual PH domains 1;
  ENSP ID: ENSP00000394973
MLGCAEEGHASLGRDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVM

SEQ ID NO: 6058 - protein, 207 aa, Homo sapiens
  Payload ID: 1321;
  Gene Symbol: ADAP1;
  Gene Name: ArfGAP with dual PH domains 1;
  ENSP ID: ENSP00000404217
  MOD_RES (1)..(1): Any amino acid
XNSLGVEKAGAAACAPGPCRACVWVVVSAMVLASLELLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKR

SEQ ID NO: 6059 - protein, 302 aa, Homo sapiens
  Payload ID: 1321;
  Gene Symbol: ADAP1;
  Gene Name: ArfGAP with dual PH domains 1;
  Uniprot ID:  O75689;
  ENSP ID: ENSP00000407267
MASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 6060 - protein, 245 aa, Homo sapiens
  Payload ID: 1321;
  Gene Symbol: ADAP1;
  Gene Name: ArfGAP with dual PH domains 1;
  ENSP ID: ENSP00000409129
YFNRNDAKEPKAVMKIEHLNATFQPAKIGHPHGLQVTYLKDNSTRNIFIYHEDGKTCLSYKIRIFIKIAPSERKASWPRPQQHQGHREIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 6061 - protein, 357 aa, Homo sapiens
  Payload ID: 1321;
  Gene Symbol: ADAP1;
  Gene Name: ArfGAP with dual PH domains 1;
  ENSP ID: ENSP00000414436
  MOD_RES (1)..(1): Any amino acid
XSFSLSLFRKHVLGPCSVSLQSPLRDSVLATSGSLAHQPISRPPCLAPVGSLLNFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 6062 - protein, 187 aa, Homo sapiens
  Payload ID: 1321;
  Gene Symbol: ADAP1;
  Gene Name: ArfGAP with dual PH domains 1;
  ENSP ID: ENSP00000416545
  MOD_RES (1)..(1): Any amino acid
XGCGLRRVVFRSLKFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDAD

SEQ ID NO: 6063 - protein, 385 aa, Homo sapiens
  Payload ID: 1321;
  Gene Symbol: ADAP1;
  Gene Name: ArfGAP with dual PH domains 1;
  Uniprot ID:  O75689;
  ENSP ID: ENSP00000442682
MFQFVFSRVYCINPARRKWKEFEKMLGCAEEGHASLGRDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 6064 - protein, 279 aa, Homo sapiens
  Payload ID: 1321;
  Gene Symbol: ADAP1;
  Gene Name: ArfGAP with dual PH domains 1;
  ENSP ID: ENSP00000478011
MVLASLELLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 6065 - protein, 302 aa, Homo sapiens; identical to SEQ ID NO: 6059
  Payload ID: 1321;
  Gene Symbol: ADAP1;
  Gene Name: ArfGAP with dual PH domains 1;
  Uniprot ID:  O75689;
  ENSP ID: ENSP00000481154

SEQ ID NO: 6066 - protein, 381 aa, Homo sapiens
  Payload ID: 1322;
  Gene Symbol: ADAP2;
  Gene Name: ArfGAP with dual PH domains 2;
  Uniprot ID:  Q9NPF8;
  ENSP ID: ENSP00000329468
MGDRERNKKRLLELLRAPDTGNAHCADCGAADPDWASYKLGIFICLNCCGVHRNFPDISRVKSVRLDFWDDSIVEFMIHNGNLRVKAKFEARVPAFYYIPQANDCLVLKEQWIRAKYERREFMADGETISLPGNREGFLWKRGRDNSQFLRRKFVLLAREGLLKYFTKEQGKSPKAVISIKDLNATFQTEKIGHPHGLQITYRRDGHTRNLFVYHESGKEIVDWFNALRAARLQYLKMAFPELPESELVPFLTRNYLKQGFMEKTGPKQKEPFKKRWFALDCHERRLLYYKNPLDAFEQGQVFLGNKEQGYEAYEDLPKGIRGNRWKAGLTIVTPERRFVLTCPSEKEQQEWLESLRGVLSSPLTPLNRLTASTESGRSSR

SEQ ID NO: 6067 - protein, 98 aa, Homo sapiens
  Payload ID: 1322;
  Gene Symbol: ADAP2;
  Gene Name: ArfGAP with dual PH domains 2;
  ENSP ID: ENSP00000462634
ESGKEIVDWFNALRAARLQYLKMAFPELPESEQKEPFKKRWFALDCHERRLLYYKNPLDAFEQGQVFLGNKEQGYEAYEDLPKGIRGNRWKAGLTIVT

SEQ ID NO: 6068 - protein, 84 aa, Homo sapiens
  Payload ID: 1322;
  Gene Symbol: ADAP2;
  Gene Name: ArfGAP with dual PH domains 2;
  ENSP ID: ENSP00000462832
MGDRERNKKRLLELLRAPDTGNAHCADCGAADPDWASYKLGIFICLNCCGVHRNFPDISRVKSVRLDFWDDSIVEGLKGTMDSS

SEQ ID NO: 6069 - protein, 145 aa, Homo sapiens
  Payload ID: 1322;
  Gene Symbol: ADAP2;
  Gene Name: ArfGAP with dual PH domains 2;
  ENSP ID: ENSP00000463649
  MOD_RES (1)..(1): Any amino acid
XFVYHESGKEIVDWFNALRAARLQYLKMAFPELPESELVPFLTRNYLKQGFMEKTGPKQKEPFKKRWFALDCHERRLLYYKNPLDAFEQGQVFLGNKEQGYEAYEDLPKGIRGNRWKAGLTIVTPERRFVLTCPTASTESGRSSR

SEQ ID NO: 6070 - protein, 106 aa, Homo sapiens
  Payload ID: 1322;
  Gene Symbol: ADAP2;
  Gene Name: ArfGAP with dual PH domains 2;
  ENSP ID: ENSP00000464120
MGDRERNKKRLLELLRAPDTGNAHCADCGAADPDWASYKLGIFICLNCCGVHRNFPDISRVKSVRLDFWDDSIVEFMIHNGNLRVKAKFEARVPAFYYIPQANDCL

SEQ ID NO: 6071 - protein, 387 aa, Homo sapiens
  Payload ID: 1322;
  Gene Symbol: ADAP2;
  Gene Name: ArfGAP with dual PH domains 2;
  ENSP ID: ENSP00000464121
MGDRERNKKRLLELLRAPDTGNAHCADCGAADPDWASYKLGIFICLNCCGVHRNFPDISRVKSVRLDFWDDSIVEVAVVLQFMIHNGNLRVKAKFEARVPAFYYIPQANDCLVLKEQWIRAKYERREFMADGETISLPGNREGFLWKRGRDNSQFLRRKFVLLAREGLLKYFTKEQGKSPKAVISIKDLNATFQTEKIGHPHGLQITYRRDGHTRNLFVYHESGKEIVDWFNALRAARLQYLKMAFPELPESELVPFLTRNYLKQGFMEKTGPKQKEPFKKRWFALDCHERRLLYYKNPLDAFEQGQVFLGNKEQGYEAYEDLPKGIRGNRWKAGLTIVTPERRFVLTCPSEKEQQEWLESLRGVLSSPLTPLNRLTASTESGRSSR

SEQ ID NO: 6072 - protein, 333 aa, Homo sapiens
  Payload ID: 1322;
  Gene Symbol: ADAP2;
  Gene Name: ArfGAP with dual PH domains 2;
  ENSP ID: ENSP00000464155
MGDRERNKKRLLELLRAPDTGNAHCADCGAADPDWASYKLGIFICLNCCGVHRNFPDISRVKSVRLDFWDDSIVEFMIHNGNLRVKAKFEARVPAFYYIPQANDCLVLKEQWIRAKYERREFMADGETISLPGNREGFLWKRGRDNSQFLRRKFVLLAREGLLKYFTKEQGKSPKAVISIKDLNATFQTEKIGHPHGLQITYRRDGHTRNLFVYHESGKLVPFLTRNYLKQGFMEKTGPKQKEPFKKRWFALDCHERRLLYYKNPLDAFEQGQVFLGNKEQGYEAYEDLPKGIRGNRWKAGLTIVTPERRFVLTCPSEKEQQEWLESLRGVLS

SEQ ID NO: 6073 - protein, 114 aa, Homo sapiens
  Payload ID: 1322;
  Gene Symbol: ADAP2;
  Gene Name: ArfGAP with dual PH domains 2;
  ENSP ID: ENSP00000467079
MADGETISLPGNREGFLWKRGRDNSQFLRRKFVLLAREGLLKYFTKEQGKSPKAVISIKDLNATFQTEKIGHPHGLQITYRRDGHTRNLFVYHESGKEIVDWFNALRAARLQYL

SEQ ID NO: 6074 - protein, 562 aa, Homo sapiens
  Payload ID: 1323;
  Gene Symbol: AGFG1;
  Gene Name: ArfGAP with FG repeats 1;
  Uniprot ID:  P52594;
  ENSP ID: ENSP00000312059
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 6075 - protein, 522 aa, Homo sapiens
  Payload ID: 1323;
  Gene Symbol: AGFG1;
  Gene Name: ArfGAP with FG repeats 1;
  Uniprot ID:  P52594;
  ENSP ID: ENSP00000362775
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 6076 - protein, 541 aa, Homo sapiens
  Payload ID: 1323;
  Gene Symbol: AGFG1;
  Gene Name: ArfGAP with FG repeats 1;
  ENSP ID: ENSP00000387154
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 6077 - protein, 560 aa, Homo sapiens
  Payload ID: 1323;
  Gene Symbol: AGFG1;
  Gene Name: ArfGAP with FG repeats 1;
  Uniprot ID:  P52594;
  ENSP ID: ENSP00000387218
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGFAAFGQTKPVVTPFGQVAAAGVSSNPFMTGAPTGQFPTGSSSTNPFL

SEQ ID NO: 6078 - protein, 584 aa, Homo sapiens
  Payload ID: 1323;
  Gene Symbol: AGFG1;
  Gene Name: ArfGAP with FG repeats 1;
  Uniprot ID:  P52594;
  ENSP ID: ENSP00000387282
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTAFRMLSSSCSFGEFTSAFPLQATHSGSAASVNANFAHFDNFPKSSSADFGTFNTSQSHQTASAVSKVSTNKAGLQTADKYAALANLDNIFSAGQGGDQGSGFGTTGKAPVGSVVSVPSQSSASSDKYAALAELDSVFSSAATSSNAYTSTSNASSNVFGTVPVVASAQTQPASSSVPAPFGATPSTNPFVAAAGPSVASSTNPFQTNARGATAATFGTASMSMPTGFGTPAPYSLPTSFSGSFQQPAFPAQAAFPQQTAFSQQPNGFAAFGQTKPVVTPFGQVAAAGVSSNPFMTGAPTGQFPTGSSSTNPFL

SEQ ID NO: 6079 - protein, 132 aa, Homo sapiens
  Payload ID: 1323;
  Gene Symbol: AGFG1;
  Gene Name: ArfGAP with FG repeats 1;
  ENSP ID: ENSP00000396469
  MOD_RES (1)..(1): Any amino acid
XTNPFQTNARGATGLSGAMHSQVFPHAHFAATFGTASMSMPTGFGTPAPYSLPTSFSGSFQQPAFPAQAAFPQQTAFSQQPNGAGFAAFGQTKPVVTPFGQVAAAGVSSNPFMTGAPTGQFPTGSSSTNPFL

SEQ ID NO: 6080 - protein, 237 aa, Homo sapiens
  Payload ID: 1323;
  Gene Symbol: AGFG1;
  Gene Name: ArfGAP with FG repeats 1;
  ENSP ID: ENSP00000405429
MLCFKRRHKVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNFGGFPTASHSPFQPQTTGGSAASVNANFAHFDNFPKSSSADFGTFNTSQSHQTASAVSKVS

SEQ ID NO: 6081 - protein, 481 aa, Homo sapiens
  Payload ID: 1324;
  Gene Symbol: AGFG2;
  Gene Name: ArfGAP with FG repeats 2;
  Uniprot ID:  O95081;
  ENSP ID: ENSP00000300176
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWYVPPDQVKGPTYTKGSASTPVQGSIPEGKPLRTLLGDPAPSLSVAASTSSQPVSQSHARTSQARSTQPPPHSSVKKASTDLLADIGGDPFAAPQMAPAFAAFPAFGGQTPSQGGFANFDAFSSGPSSSVFGSLPPAGQASFQAQPTPAGSSQGTPFGATPLAPASQPNSLADVGSFLGPGVPAAGVPSSLFGMAGQVPPLQSVTMGGGGGSSTGLAFGAFTNPFTAPAAQSPLPSTNPFQPNGLAPGPGFGMSSAGPGFPQAVPPTGAFASSFPAPLFPPQTPLVQQQNGSSFGDLGSAKLGQRPLSQPAGISTNPFMTGPSSSPFASKPPTTNPFL

SEQ ID NO: 6082 - protein, 223 aa, Homo sapiens
  Payload ID: 1324;
  Gene Symbol: AGFG2;
  Gene Name: ArfGAP with FG repeats 2;
  ENSP ID: ENSP00000388594
  MOD_RES (1)..(1): Any amino acid
XSSVFGSLPPAGQASFQAQPTPAASRMLTESYSFGSSQGTPFGATPLAPASQPNSLADVGSFLGPGVPAAGVPSSLFGMAGQVPPLQSVTMGGGGGSSTGLAFGAFTNPFTAPAAQSPLPSTNPFQPNGLAPGPGFGMSSAGPGFPQAVPPTGAFASSFPAPLFPPQTPLVQQQNGSSFGDLGSAKLGQRPLSQPAGISTNPFMTGPSSSPFASKPPTTNPFL

SEQ ID NO: 6083 - protein, 155 aa, Homo sapiens
  Payload ID: 1324;
  Gene Symbol: AGFG2;
  Gene Name: ArfGAP with FG repeats 2;
  ENSP ID: ENSP00000394453
MVMAAKKGPGPGGGVSGGKAEAEAASEVWCRRVRELGGCSQAGNRHCFECAQRGVTYVDITVGSFVCTTCSGLLRGLNPPHRVKSISMTTFTEPEVVFLQSRGNEVCRKIWLGLFDARTSLVPDSRDPQKVKEFLQEKYEKKRWPDTFPRRLCQL

SEQ ID NO: 6084 - protein, 857 aa, Homo sapiens
  Payload ID: 1325;
  Gene Symbol: AGAP1;
  Gene Name: ArfGAP with GTPase domain, ankyrin repeat and PH domain 1;
  Uniprot ID:  Q9UPQ3;
  ENSP ID: ENSP00000307634
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 6085 - protein, 804 aa, Homo sapiens
  Payload ID: 1325;
  Gene Symbol: AGAP1;
  Gene Name: ArfGAP with GTPase domain, ankyrin repeat and PH domain 1;
  Uniprot ID:  Q9UPQ3;
  ENSP ID: ENSP00000338378
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 6086 - protein, 117 aa, Homo sapiens
  Payload ID: 1325;
  Gene Symbol: AGAP1;
  Gene Name: ArfGAP with GTPase domain, ankyrin repeat and PH domain 1;
  ENSP ID: ENSP00000385492
MDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSE

SEQ ID NO: 6087 - protein, 1069 aa, Homo sapiens
  Payload ID: 1325;
  Gene Symbol: AGAP1;
  Gene Name: ArfGAP with GTPase domain, ankyrin repeat and PH domain 1;
  ENSP ID: ENSP00000386897
MYLLDGSGEPASPPADAMPRGTPPRKTVYRISVTMVRKEQLAAPGSGGPDPRPVRRPRPARSPDAPGRLEEEAEEAEGAEEPEGPRPRAWDFRTFRTRSTGQLELGRLRPCARGLEPADLAGSAPAEEEGRGSPASGSPDVEGARAAPLRRSLSFRHWSGPEAPQGRTLGGGRRHSSSGSLAWAPCDEAAAGTTLEPATATQPASEKRNTLDVGEVLSKNDALSDLERWERSKSKNRTLDNSDLQRLERARAAAGAGAASEHRLLRFFSGIFARRDGGPGGGPSPRSGASRPRGYFSLRRAPAEAHSSSAESIDGSPRRDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 6088 - protein, 405 aa, Homo sapiens
  Payload ID: 1325;
  Gene Symbol: AGAP1;
  Gene Name: ArfGAP with GTPase domain, ankyrin repeat and PH domain 1;
  Uniprot ID:  Q9UPQ3;
  ENSP ID: ENSP00000387174
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGLPFFVLALTASTYLRPAGARARQSSPWPGPRGGQTSPHCAEGPQSAQLSGAMMN

SEQ ID NO: 6089 - protein, 276 aa, Homo sapiens
  Payload ID: 1325;
  Gene Symbol: AGAP1;
  Gene Name: ArfGAP with GTPase domain, ankyrin repeat and PH domain 1;
  ENSP ID: ENSP00000393838
  MOD_RES (1)..(1): Any amino acid
XSSPKTNGLSKDMSSLHISPNSDTGLGDSVCSSPSISSTTSPKLDPPPSPHANRKKHRRKKSTSNFKADGLSGTAEAKRKAWKLNRVGSLRNIYSSSTNTEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLA

SEQ ID NO: 6090 - protein, 253 aa, Homo sapiens
  Payload ID: 1325;
  Gene Symbol: AGAP1;
  Gene Name: ArfGAP with GTPase domain, ankyrin repeat and PH domain 1;
  ENSP ID: ENSP00000403482
  MOD_RES (1)..(1): Any amino acid
XKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEAKRKAWKLNRVGSLRNIYSSSTNTEEQEENFEFIIVSLTGQTWHFEATTYEERDAWVQAIESQILASLQSC

SEQ ID NO: 6091 - protein, 803 aa, Homo sapiens
  Payload ID: 1325;
  Gene Symbol: AGAP1;
  Gene Name: ArfGAP with GTPase domain, ankyrin repeat and PH domain 1;
  ENSP ID: ENSP00000411824
DAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 6092 - protein, 351 aa, Homo sapiens
  Payload ID: 1325;
  Gene Symbol: AGAP1;
  Gene Name: ArfGAP with GTPase domain, ankyrin repeat and PH domain 1;
  ENSP ID: ENSP00000483085
DAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGLPFFVLALTASTYLRPAGARARQSSPWPGPRGGQTSPHCAEGPQSAQLSGAMMN

SEQ ID NO: 6093 - protein, 750 aa, Homo sapiens
  Payload ID: 1325;
  Gene Symbol: AGAP1;
  Gene Name: ArfGAP with GTPase domain, ankyrin repeat and PH domain 1;
  ENSP ID: ENSP00000484463
DAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 6094 - protein, 108 aa, Homo sapiens
  Payload ID: 1325;
  Gene Symbol: AGAP1;
  Gene Name: ArfGAP with GTPase domain, ankyrin repeat and PH domain 1;
  ENSP ID: ENSP00000489496
QLANSAAIRAEIQRFESVHPNIYSIYELLERVEEPVLQNQIREHVIAIEDAFVNSQEWTLSRSVPELKVGIVGNLASGKSALVHRYLTGTYVQEEYGCRWQVQERDCR

SEQ ID NO: 6095 - protein, 836 aa, Homo sapiens
  Payload ID: 1326;
  Gene Symbol: AGAP2;
  Gene Name: ArfGAP with GTPase domain, ankyrin repeat and PH domain 2;
  Uniprot ID:  Q99490;
  ENSP ID: ENSP00000257897
MHAQRQFVVAAVRAEVRRHEVAKQALNRLRKLAERVDDPELQDSIQASLDSIREAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEEENFEFLIVSSTGQTWHFEAASFEERDAWVQAIESQILASLQCCESSKVKLRTDSQSEAVAIQAIRNAKGNSICVDCGAPNPTWASLNLGALICIECSGIHRNLGTHLSRVRSLDLDDWPRELTLVLTAIGNDTANRVWESDTRGRAKPSRDSSREERESWIRAKYEQLLFLAPLSTSEEPLGRQLWAAVQAQDVATVLLLLAHARHGPLDTSVEDPQLRSPLHLAAELAHVVITQLLLWYGADVAARDAQGRTALFYARQAGSQLCADILLQHGCPGEGGSAATTPSAATTPSITATPSPRRRSSAASVGRADAPVALV

SEQ ID NO: 6096 - protein, 1036 aa, Homo sapiens
  Payload ID: 1326;
  Gene Symbol: AGAP2;
  Gene Name: ArfGAP with GTPase domain, ankyrin repeat and PH domain 2;
  ENSP ID: ENSP00000328160
  MOD_RES (1)..(1): Any amino acid
XTSSRRPLLSSPSWGGPEPEGRAGGGIPGSSSPHPGTGSRRLKVAPPPPAPKPCKTVTTSGAKAGGGKGAGSRLSWPESEGKPRVKGSKSSAGTGASVSAAATAAAAGGGGSTASTSGGVGAGAGARGKLSPRKGKSKTLDNSDLHPGPPAGSPPPLTLPPTPSPATAVTAASAQPPGPAPPITLEPPAPGLKRGREGGRASTRDRKMLKFISGIFTKSTGGPPGSGPLPGPPSLSSGSGSRELLGAELRASPKAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEEENFEFLIVSSTGQTWHFEAASFEERDAWVQAIESQILASLQCCESSKVKLRTDSQSEAVAIQAIRNAKGNSICVDCGAPNPTWASLNLGALICIECSGIHRNLGTHLSRVRSLDLDDWPRELTLVLTAIGNDTANRVWESDTRGRAKPSRDSSREERESWIRAKYEQLLFLAPLSTSEEPLGRQLWAAVQAQDVATVLLLLAHARHGPLDTSVEDPQLRSPLHLAAELAHVVITQLLLWYGADVAARDAQGRTALFYARQAGSQLCADILLQHGCPGEGGSAATTPSAATTPSITATPSPRRRSSAASVGRADAPVALV

SEQ ID NO: 6097 - protein, 169 aa, Homo sapiens
  Payload ID: 1326;
  Gene Symbol: AGAP2;
  Gene Name: ArfGAP with GTPase domain, ankyrin repeat and PH domain 2;
  ENSP ID: ENSP00000446683
RRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTGQWG

SEQ ID NO: 6098 - protein, 1192 aa, Homo sapiens
  Payload ID: 1326;
  Gene Symbol: AGAP2;
  Gene Name: ArfGAP with GTPase domain, ankyrin repeat and PH domain 2;
  ENSP ID: ENSP00000449241
MSRGAGALQRRTTTYLISLTLVKLESVPPPPPSPSAAAAGAAGARGSETGDPGSPRGAEEPGKKRHERLFHRQDALWISTSSAGTGGAEPPALSPAPASPARPVSPAPGRRLSLWAVPPGPPLSGGLSPDPKPGGAPTSSRRPLLSSPSWGGPEPEGRAGGGIPGSSSPHPGTGSRRLKVAPPPPAPKPCKTVTTSGAKAGGGKGAGSRLSWPESEGKPRVKGSKSSAGTGASVSAAATAAAAGGGGSTASTSGGVGAGAGARGKLSPRKGKSKTLDNSDLHPGPPAGSPPPLTLPPTPSPATAVTAASAQPPGPAPPITLEPPAPGLKRGREGGRASTRDRKMLKFISGIFTKSTGGPPGSGPLPGPPSLSSGSGSRELLGAELRASPKAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEAKRKMWKLKSFGSLRNIYKAEENFEFLIVSSTGQTWHFEAASFEERDAWVQAIESQILASLQCCESSKVKLRTDSQSEAVAIQAIRNAKGNSICVDCGAPNPTWASLNLGALICIECSGIHRNLGTHLSRVRSLDLDDWPRELTLVLTAIGNDTANRVWESDTRGRAKPSRDSSREERESWIRAKYEQLLFLAPLSTSEEPLGRQLWAAVQAQDVATVLLLLAHARHGPLDTSVEDPQLRSPLHLAAELAHVVITQLLLWYGADVAARDAQGRTALFYARQAGSQLCADILLQHGCPGEGGSAATTPSAATTPSITATPSPRRRSSAASVGRADAPVALV

SEQ ID NO: 6099 - protein, 576 aa, Homo sapiens
  Payload ID: 1327;
  Gene Symbol: AGAP3;
  Gene Name: ArfGAP with GTPase domain, ankyrin repeat and PH domain 3;
  ENSP ID: ENSP00000335589
MERGWPQGDSCPGERPAACRRAHSVCDSLDLHGASAGRAAAALQAALCAASEQPARPRSVCSGGPEPPPTGARGLLLGLLRPRLGRRGLAPSGPPVSPAPSPASSPAPTRRSRTRGEPTPRPRPASMTFLEVNRLELAAAEAPGAGLGRAGSAGFLRGAALWSSQRWPVLRGGRGPEGPRRGLAALRKSFSFRLRRGQEVRRSESGLLARPPRARTRSDGDAGSLGAFPSRRDLLGSDAPRAAPEPGRPRTAAGLWRLLTSRFRRREPAPAAPLWGRRAAAAPELLRAPSDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTICATVSNFSSTKRPFQLLPN

SEQ ID NO: 6100 - protein, 911 aa, Homo sapiens
  Payload ID: 1327;
  Gene Symbol: AGAP3;
  Gene Name: ArfGAP with GTPase domain, ankyrin repeat and PH domain 3;
  Uniprot ID:  Q96P47;
  ENSP ID: ENSP00000380413
MNFQAGGGQSPQQQQSLAAPGGGGAAAQQLVCGGQFGGAGPGAGGGGGPSQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 6101 - protein, 194 aa, Homo sapiens
  Payload ID: 1327;
  Gene Symbol: AGAP3;
  Gene Name: ArfGAP with GTPase domain, ankyrin repeat and PH domain 3;
  ENSP ID: ENSP00000417151
  MOD_RES (1)..(1): Any amino acid
XEGERSRGLREPGRSGLSGAGRGLHRPCLAMLSLSGVLARLRTRPRDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDL

SEQ ID NO: 6102 - protein, 404 aa, Homo sapiens
  Payload ID: 1327;
  Gene Symbol: AGAP3;
  Gene Name: ArfGAP with GTPase domain, ankyrin repeat and PH domain 3;
  ENSP ID: ENSP00000417910
  MOD_RES (1)..(1): Any amino acid
XEIDLLRTTVKVPGKRLPRATPATAPGTSPRANGLSVERSNTQLGGGTASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 6103 - protein, 580 aa, Homo sapiens
  Payload ID: 1327;
  Gene Symbol: AGAP3;
  Gene Name: ArfGAP with GTPase domain, ankyrin repeat and PH domain 3;
  Uniprot ID:  Q96P47;
  ENSP ID: ENSP00000418016
MVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 6104 - protein, 343 aa, Homo sapiens
  Payload ID: 1327;
  Gene Symbol: AGAP3;
  Gene Name: ArfGAP with GTPase domain, ankyrin repeat and PH domain 3;
  ENSP ID: ENSP00000418125
MNFQAGGGQSPQQQQSLAAPGGGGAAAQQLVCGGQFGGAGPGAGGGGGPSQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQICATVSNFSSTKRPFQLLPN

SEQ ID NO: 6105 - protein, 177 aa, Homo sapiens
  Payload ID: 1327;
  Gene Symbol: AGAP3;
  Gene Name: ArfGAP with GTPase domain, ankyrin repeat and PH domain 3;
  ENSP ID: ENSP00000418159
DAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTLMNRRPEGCLPKATQRICATVSNFSSTKRPFQLLPN

SEQ ID NO: 6106 - protein, 396 aa, Homo sapiens
  Payload ID: 1327;
  Gene Symbol: AGAP3;
  Gene Name: ArfGAP with GTPase domain, ankyrin repeat and PH domain 3;
  Uniprot ID:  Q96P47;
  ENSP ID: ENSP00000418921
MNFQAGGGQSPQQQQSLAAPGGGGAAAQQLVCGGQFGGAGPGAGGGGGPSQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTICATVSNFSSTKRPFQLLPN

SEQ ID NO: 6107 - protein, 170 aa, Homo sapiens
  Payload ID: 1327;
  Gene Symbol: AGAP3;
  Gene Name: ArfGAP with GTPase domain, ankyrin repeat and PH domain 3;
  ENSP ID: ENSP00000419801
  MOD_RES (1)..(1): Any amino acid
XMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTLMNRRPEGCLPKATQRVSWPS

SEQ ID NO: 6108 - protein, 875 aa, Homo sapiens
  Payload ID: 1327;
  Gene Symbol: AGAP3;
  Gene Name: ArfGAP with GTPase domain, ankyrin repeat and PH domain 3;
  Uniprot ID:  Q96P47;
  ENSP ID: ENSP00000480655
MNFQAGGGQSPQQQQQLAGGPPQQFALSNSAAIRAEIQRFESVHPNIYAIYDLIERIEDLALQNQIREHVISIEDSFVNSQEWTLSRSVPELKVGIVGNLSSGKSALVHRYLTGTYVQEESPEGGRFKKEIVVDGQSYLLLIRDEGGPPELQFAAWVDAVVFVFSLEDEISFQTVYNYFLRLCSFRNASEVPMVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTGAPHSASSASLHSERPLSSSAWAGPRPEGLHQRSCSVSSADQWSEATTSLPPGMQHPASGPAEVLSSSPKLDPPPSPHSNRKKHRRKKSTGTPRPDGPSSATEEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 6109 - protein, 663 aa, Homo sapiens
  Payload ID: 1328;
  Gene Symbol: AGAP4;
  Gene Name: ArfGAP with GTPase domain, ankyrin repeat and PH domain 4;
  ENSP ID: ENSP00000309985
MGNILTCRVHPSVSLEFDQQQGSVCPSESEIYEAGAGDRMAGAPMAAAVQPAEVTVEVGEDLHMHHVRDREMPEALEFNLSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISTSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDKCV

SEQ ID NO: 6110 - protein, 663 aa, Homo sapiens
  Payload ID: 1328;
  Gene Symbol: AGAP4;
  Gene Name: ArfGAP with GTPase domain, ankyrin repeat and PH domain 4;
  Uniprot ID:  Q96P64;
  ENSP ID: ENSP00000392513
MGNILTCRVHPSVSLEFDQQQGSVCPSESEIYEAGAGDRMAGAPMAAAVQPAEVTVEVGEDLHMHHVRDREMPEALEFNPSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISTSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDKCV

SEQ ID NO: 6111 - protein, 137 aa, Homo sapiens
  Payload ID: 1328;
  Gene Symbol: AGAP4;
  Gene Name: ArfGAP with GTPase domain, ankyrin repeat and PH domain 4;
  ENSP ID: ENSP00000468160
AGAPMAAAVQPAEVTVEVGEDLHMHHVRDREMPEALEFNLSANPEASTIFQRNSQTDALEFNPSANPEASTIFQRNSQTDVVEIRRSNCTNHVSTVRFSQQYSLCSTIFLDDSTAIQHYLTMTIISVTLEIPHHITQ

SEQ ID NO: 6112 - protein, 658 aa, Homo sapiens
  Payload ID: 1328;
  Gene Symbol: AGAP4;
  Gene Name: ArfGAP with GTPase domain, ankyrin repeat and PH domain 4;
  ENSP ID: ENSP00000478047
MGNILTCRVHPSVSLEFDQQQGSVCPSESEIYEAGAGDRMAGAPMAAAVQPAEVTVEVGEDLHMHHVRDREMPEALEFNLSANPEASTIFQRNSQTDALEFNPSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISTSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLTGWTSWPEMPTGTQR

SEQ ID NO: 6113 - protein, 686 aa, Homo sapiens
  Payload ID: 1328;
  Gene Symbol: AGAP4;
  Gene Name: ArfGAP with GTPase domain, ankyrin repeat and PH domain 4;
  ENSP ID: ENSP00000483751
MGNILTCRVHPSVSLEFDQQQGSVCPSESEIYEAGAGDRMAGAPMAAAVQPAEVTVEVGEDLHMHHVRDREMPEALEFNLSANPEASTIFQRNSQTEALEFNPSANPEASTIFQRNSQTDVVEIRRSNCTNHVSTVRFSQQYSLCSTIFLDDSTAIQHYLTMTIISVTLEIPHHITQRDADRSLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLQTSTIKVPGKWPSLATSACTPISTSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSKAMALQSIQNMRGNAHCVDCETQNPKWASLNLGVLMCIECSGIHRSLGTRLSRVRSLELDDWPVELRKVMSSIGNDLANSIWEGSSQGQTKPSEKSTREEKERWIRSKYEEKLFLAPLPCTELSLGQQLLRATADEDLQTAILLLAHGSREEVNETCGEGDGCTALHLACRKGNVVLAQLLIWYGVDVMARDAHGNTALTYARQASSQECINVLLQYGCPDKCV

SEQ ID NO: 6114 - protein, 686 aa, Homo sapiens
  Payload ID: 1329;
  Gene Symbol: AGAP5;
  Gene Name: ArfGAP with GTPase domain, ankyrin repeat and PH domain 5;
  Uniprot ID:  A6NIR3;
  ENSP ID: ENSP00000363207
MGNILTCCVHPSVSLEFDQQQGSVCPSESEIYEAGAGDRMAGAPMAAAVQPAEVTVEVGEDLHMHHIRDQEMPEALEFSLSANPEASTIFQRNSQTDALEFNPSANPEASTIFQRNSQTDVVEIRRSNCTNHVSTERFSQQYSSCSTIFLDDSTASQHYLTMTIISVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSHPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDYETQNPKWASLNLGVLMCIECSGIHRSLGTRLSRVRSLELDDWPVELRKVMSSIGNDLANSIWEGSSQGQTKPSVKSTREEKERWIRSKYEEKLFLAPLPCTELSLGQHLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 6115 - protein, 663 aa, Homo sapiens
  Payload ID: 1329;
  Gene Symbol: AGAP5;
  Gene Name: ArfGAP with GTPase domain, ankyrin repeat and PH domain 5;
  ENSP ID: ENSP00000402792
MGNILTCCVHPSVSLEFDQQQGSVCPSESEIYEAGAGDRMAGAPMAAAVQPAEVTVEVGEDLHMHHIRDQEMPEALEFNPSANPEASTIFQRNSQTDVVEIRRSNCTNHVSTERFSQQYSSCSTIFLDDSTASQHYLTMTIISVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSHPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDYETQNPKWASLNLGVLMCIECSGIHRSLGTRLSRVRSLELDDWPVELRKVMSSIGNDLANSIWEGSSQGQTKPSVKSTREEKERWIRSKYEEKLFLAPLPCTELSLGQHLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 6116 - protein, 27 aa, Homo sapiens
  Payload ID: 1329;
  Gene Symbol: AGAP5;
  Gene Name: ArfGAP with GTPase domain, ankyrin repeat and PH domain 5;
  ENSP ID: ENSP00000475576
  MOD_RES (1)..(1): Any amino acid
XYSSCSTIFLDDSTASQHYLTMTIISH

SEQ ID NO: 6117 - protein, 658 aa, Homo sapiens
  Payload ID: 1329;
  Gene Symbol: AGAP5;
  Gene Name: ArfGAP with GTPase domain, ankyrin repeat and PH domain 5;
  ENSP ID: ENSP00000483632
MGNILTCCVHPSVSLEFDQQQGSVCPSESEIYEAGAGDRMAGAPMAAAVQPAEVTVEVGEDLHMHHIRDQEMPEALEFSLSANPEASTIFQRNSQTDALEFNPSANPEASTIFQRNSQTDVVEIRRSNCTNHVSTERFSQQYSSCSTIFLDDSTASQHYLTMTIISVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSHPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDYETQNPKWASLNLGVLMCIECSGIHRSLGTRLSRVRSLELDDWPVELRKVMSSIGNDLANSIWEGSSQGQTKPSVKSTREEKERWIRSKYEEKLFLAPLPCTELSLGQHLLRATADEDLQTAILLLAHGSREEVNETCGEGDGCTALHLACRKGNVVLAQLLTGWTSWPEMPTGTQR

SEQ ID NO: 6118 - protein, 686 aa, Homo sapiens
  Payload ID: 1329;
  Gene Symbol: AGAP5;
  Gene Name: ArfGAP with GTPase domain, ankyrin repeat and PH domain 5;
  ENSP ID: ENSP00000486918
MGNILTCCVHPSVSLEFDQQQGSVCPSESEIYEAGAGDRMAGAPMAAAVQPAEVTVEVGEDLHMHHIRDQEMPEALEFSLSANPEASTIFQRNSQTEALEFNPSANPEASTIFQRNSQTDVVEIRRSNCTNHVSTERFSQQYSSCSTIFLDDSTASQHYLTMTIISVTLEIPHHITQRDADRSLSIPDEQLHSFAVSTVHITKNRNGGGSLNNYSSSIPSTPSTSQEDPQFSVPPTANTPTPVCKRSMRWSNLFTSEKGSHPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDYETQNPKWASLNLGVLMCIECSGIHRSLGTRLSRVRSLELDDWPVELRKVMSSIGNDLANSIWEGSSQGQTKPSVKSTREEKERWIRSKYEEKLFLAPLPCTELSLGQHLLRATADEDLQTAILLLAHGSREEVNETCGEGDGCTALHLACRKGNVVLAQLLIWYGVDVMARDAHGNTALTYARQASSQECINVLLQYGCPDECV

SEQ ID NO: 6119 - protein, 663 aa, Homo sapiens
  Payload ID: 1330;
  Gene Symbol: AGAP6;
  Gene Name: ArfGAP with GTPase domain, ankyrin repeat and PH domain 6;
  Uniprot ID:  Q5VW22;
  ENSP ID: ENSP00000363168
MGNILTCRVHPSVSLEFDQQQGSVCPSESETYEAGARDRMAGAPMAAAVQPAEVTVEVGEDLHMHHVRDREMPEALEFNPSANPEASTIFQRNSQTDVVEIRRSNCTNHVSAVRFSQQYSLCSTIFLDDSTAIQHYLTMTIISVTLEIPHHITQRDADRTLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLIWYGVDVMARDAHGNTALTYARQASSQECINVLLQYGCPDECV

SEQ ID NO: 6120 - protein, 686 aa, Homo sapiens
  Payload ID: 1330;
  Gene Symbol: AGAP6;
  Gene Name: ArfGAP with GTPase domain, ankyrin repeat and PH domain 6;
  Uniprot ID:  Q5VW22;
  ENSP ID: ENSP00000400972
MGNILTCRVHPSVSLEFDQQQGSVCPSESETYEAGARDRMAGAPMAAAVQPAEVTVEVGEDLHMHHVRDREMPEALEFNLSANPESSTIFQRNSQTEALEFNPSANPEASTIFQRNSQTDVVEIRRSNCTNHVSAVRFSQQYSLCSTIFLDDSTAIQHYLTMTIISVTLEIPHHITQRDADRTLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLIWYGVDVMARDAHGNTALTYARQASSQECINVLLQYGCPDECV

SEQ ID NO: 6121 - protein, 555 aa, Homo sapiens
  Payload ID: 1330;
  Gene Symbol: AGAP6;
  Gene Name: ArfGAP with GTPase domain, ankyrin repeat and PH domain 6;
  ENSP ID: ENSP00000483426
MVSAVRFSQQYSLCSTIFLDDSTAIQHYLTMTIISVTLEIPHHITQRDADRTLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLIWYGVDVMARDAHGNTALTYARQASSQECINVLLQYGCPDECV

SEQ ID NO: 6122 - protein, 658 aa, Homo sapiens
  Payload ID: 1330;
  Gene Symbol: AGAP6;
  Gene Name: ArfGAP with GTPase domain, ankyrin repeat and PH domain 6;
  ENSP ID: ENSP00000485012
MGNILTCRVHPSVSLEFDQQQGSVCPSESETYEAGARDRMAGAPMAAAVQPAEVTVEVGEDLHMHHVRDREMPEALEFNLSANPESSTIFQRNSQTEALEFNPSANPEASTIFQRNSQTDVVEIRRSNCTNHVSAVRFSQQYSLCSTIFLDDSTAIQHYLTMTIISVTLEIPHHITQRDADRTLSIPDEQLHSFAVSTVHIMKKRNGGGSLNNYSSSIPSTPSTSQEDPQFSVPPTANTPTPVCKRSMRWSNLFTSEKGSDPDKERKAPENHADTIGSGRAIPIKQGMLLKRSGKWLKTWKKKYVTLCSNGMLTYYSSLGDYMKNIHKKEIDLQTSTIKVPGKWPSLATSACTPISSSKSNGLSKDMDTGLGDSICFSPSISSTTSPKLNPPPSPHANKKKHLKKKSTNNFMIVSATGQTWHFEATTYEERDAWVQAIQSQILASLQSCESSKSKSQLTSQSEAMALQSIQNMRGNAHCVDCETQNPKWASLNLGVLMCIECSGIHRSLGPHLSRVRSLELDDWPVELRKVMSSIVNDLANSIWEGSSQGQTKPSEKSTREEKERWIRSKYEEKLFLAPLPCTELSLGQQLLRATADEDLQTAILLLAHGSCEEVNETCGEGDGCTALHLACRKGNVVLAQLLTGWTSWPEMPTGTQR

SEQ ID NO: 6123 - protein, 658 aa, Homo sapiens
  Payload ID: 1331;
  Gene Symbol: AGAP9;
  Gene Name: ArfGAP with GTPase domain, ankyrin repeat and PH domain 9;
  Uniprot ID:  Q5VTM2;
  ENSP ID: ENSP00000392206
MGNILTCRVHPSVSLEFDQQQGSVCPSESEIYEAGAEDRMAGAPMAAAVQPAEVTVEVGEDLHMHQVRDREMPEALEFNLSANPEASTIFQRNSQTDALEFNSSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTPVCKRSMRWSNLFTSEKGSDPDKERKAPENHADTIGSGRAIPIKQGMLLKRSGKWLKTWKKKYVTLCSNGVLTYYSSLGDYMKNIHKKEIDLRTSTIKVPGKWPSLATSACAPISSSKSNGLSKDMDTGLGDSICFSPGISSTTSPKLNPPPSPHANKKKHLKKKSTNNFMIVSATGQTWHFEATTYEERDAWVQAIQSQILASLQSCKSSKSKSQLTSQSEAMALQSIQNMRGNAHCVDCETQNPKWASLNLGVLMCIECSGIHRSFGTRLSRVRSLELDDWPVELRKVMSSIGNELANSIWEGSSQGQTKPSIKSTREEKEWWIRSKYEEKLFLAPLPCTELSLGQQLLRATTDEDLQTAILLLAHGSREEVNETCGEGDGCTALHLACRKGNVVLEQLLTGWTSWPEMPTGTQR

SEQ ID NO: 6124 - protein, 1205 aa, Homo sapiens
  Payload ID: 1332;
  Gene Symbol: ARAP1;
  Gene Name: ArfGAP with RhoGAP domain, ankyrin repeat and PH domain 1;
  Uniprot ID:  Q96P48;
  ENSP ID: ENSP00000335506
MTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSQRPWSGAPETSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 6125 - protein, 1439 aa, Homo sapiens
  Payload ID: 1332;
  Gene Symbol: ARAP1;
  Gene Name: ArfGAP with RhoGAP domain, ankyrin repeat and PH domain 1;
  Uniprot ID:  Q96P48;
  ENSP ID: ENSP00000352332
MAEAGDAALSVAEWLRALHLEQYTGLFEQHGLVWATECQGLSDTRLMDMGMLLPGHRRRILAGLLRAHTSPAPAPRPTPRPVPMKRHIFRSPPVPATPPEPLPTTTEDEGLPAAPPIPPRRSCLPPTCFTTPSTAAPDPVLPPLPAKRHLAELSVPPVPPRTGPPRLLVSLPTKEEESLLPSLSSPPQPQSEEPLSTLPQGPPQPPSPPPCPPEIPPKPVRLFPEFDDSDYDEVPEEGPGAPARVMTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 6126 - protein, 1210 aa, Homo sapiens
  Payload ID: 1332;
  Gene Symbol: ARAP1;
  Gene Name: ArfGAP with RhoGAP domain, ankyrin repeat and PH domain 1;
  Uniprot ID:  Q96P48;
  ENSP ID: ENSP00000377230
MTLSGSRGQEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSQRPWSGAPETSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 6127 - protein, 1450 aa, Homo sapiens
  Payload ID: 1332;
  Gene Symbol: ARAP1;
  Gene Name: ArfGAP with RhoGAP domain, ankyrin repeat and PH domain 1;
  Uniprot ID:  Q96P48;
  ENSP ID: ENSP00000377233
MAEAGDAALSVAEWLRALHLEQYTGLFEQHGLVWATECQGLSDTRLMDMGMLLPGHRRRILAGLLRAHTSPAPAPRPTPRPVPMKRHIFRSPPVPATPPEPLPTTTEDEGLPAAPPIPPRRSCLPPTCFTTPSTAAPDPVLPPLPAKRHLAELSVPPVPPRTGPPRLLVSLPTKEEESLLPSLSSPPQPQSEEPLSTLPQGPPQPPSPPPCPPEIPPKPVRLFPEFDDSDYDEVPEEGPGAPARVMTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSQRPWSGAPETSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 6128 - protein, 679 aa, Homo sapiens
  Payload ID: 1332;
  Gene Symbol: ARAP1;
  Gene Name: ArfGAP with RhoGAP domain, ankyrin repeat and PH domain 1;
  ENSP ID: ENSP00000390461
IDASGKGEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 6129 - protein, 1194 aa, Homo sapiens
  Payload ID: 1332;
  Gene Symbol: ARAP1;
  Gene Name: ArfGAP with RhoGAP domain, ankyrin repeat and PH domain 1;
  ENSP ID: ENSP00000392264
MTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 6130 - protein, 254 aa, Homo sapiens
  Payload ID: 1332;
  Gene Symbol: ARAP1;
  Gene Name: ArfGAP with RhoGAP domain, ankyrin repeat and PH domain 1;
  ENSP ID: ENSP00000399118
MEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLG

SEQ ID NO: 6131 - protein, 1133 aa, Homo sapiens
  Payload ID: 1332;
  Gene Symbol: ARAP1;
  Gene Name: ArfGAP with RhoGAP domain, ankyrin repeat and PH domain 1;
  Uniprot ID:  Q96P48;
  ENSP ID: ENSP00000403127
MTKKEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIEALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 6132 - protein, 307 aa, Homo sapiens
  Payload ID: 1332;
  Gene Symbol: ARAP1;
  Gene Name: ArfGAP with RhoGAP domain, ankyrin repeat and PH domain 1;
  ENSP ID: ENSP00000411452
MEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKE

SEQ ID NO: 6133 - protein, 233 aa, Homo sapiens
  Payload ID: 1332;
  Gene Symbol: ARAP1;
  Gene Name: ArfGAP with RhoGAP domain, ankyrin repeat and PH domain 1;
  ENSP ID: ENSP00000441741
MTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGTSAQRLSTGAHPW

SEQ ID NO: 6134 - protein, 178 aa, Homo sapiens
  Payload ID: 1332;
  Gene Symbol: ARAP1;
  Gene Name: ArfGAP with RhoGAP domain, ankyrin repeat and PH domain 1;
  ENSP ID: ENSP00000442746
  MOD_RES (1)..(1): Any amino acid
XKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSVSGSPCLWAGGWGPGWVPAFYSTVDDCPDCPPRLPSGPLPPALVGALIGLFGSHHSKEPLLPGPGSWESPLPGPGSWEPG

SEQ ID NO: 6135 - protein, 1704 aa, Homo sapiens
  Payload ID: 1333;
  Gene Symbol: ARAP2;
  Gene Name: ArfGAP with RhoGAP domain, ankyrin repeat and PH domain 2;
  Uniprot ID:  Q8WZ64;
  ENSP ID: ENSP00000302895
MSSVSEVNVDIKDFLMSINLEQYLLHFHESGFTTVKDCAAINDSLLQKIGISPTGHRRRILKQLQIILSKMQDIPIYANVHKTKKNDDPSKDYHVPSSDQNICIELSNSGSVQTSSPPQLETVRKNLEDSDASVERSQYPQSDDKLSPPKRDFPTAEEPHLNLGSLNDSLFGSDNIKIESLITKKTVDHTVEEQQTEKVKLITENLSKLPNADSECLSFVGCSTSGTNSGNGTNGLLEGSPPSPFFKFQGEMIVNDLYVPSSPILAPVRSRSKLVSRPSRSFLLRHRPVPEIPGSTKGVSGSYFRERRNVATSTEKSVAWQNSNEENSSSIFPYGETFLFQRLENSKKRSIKNEFLTQGEALKGEAATATNSFIIKSSIYDNRKEKISEDKVEDIWIPREDKNNFLIDTASESEYSTVEECFQSLRRKNSKASKSRTQKALILDSVNRHSYPLSSTSGNADSSAVSSQAISPYACFYGASAKKVKSGWLDKLSPQGKRMFQKRWVKFDGLSISYYNNEKEMYSKGIIPLSAISTVRVQGDNKFEVVTTQRTFVFRVEKEEERNDWISILLNALKSQSLTSQSQAVVTPEKCGYLELRGYKAKIFTVLSGNSVWLCKNEQDFKSGLGITIIPMNVANVKQVDRTVKQSFEIITPYRSFSFTAETEKEKQDWIEAVQQSIAETLSDYEVAEKIWFNESNRSCADCKAPDPDWASINLCVVICKKCAGQHRSLGPKDSKVRSLKMDASIWSNELIELFIVIGNKRANDFWAGNLQKDEELHMDSPVEKRKNFITQKYKEGKFRKTLLASLTKEELNKALCAAVVKPDVLETMALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSQAQRKWTEAIAKHFVPLFAENLTEADYDLIGQLFYKDCHALDQWRKGWFAMDKSSLHFCLQMQEVQGDRMHLRRLQELTISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEVKEDQVKQMDIENSFITKWKDTQVSQAGDLLIEVYVERKEPDCSIIIRISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTSWGLTAYSEKHHWHLCCDSSRTQTEWMTSIFIAQHEYDIWPPAGKERKRSITKNPKIGGLPLIPIQHEGNATLARKNIESARAELERLRLSEKCDKESVDSSLKERASMVAHCLEHKDDKLRNRPRKHRSFNCLEDTEPEAPLGQPKGHKGLKTLRKTEDRNSKATLDSDHKLPSRVIEELNVVLQRSRTLPKELQDEQILK

SEQ ID NO: 6136 - protein, 47 aa, Homo sapiens
  Payload ID: 1333;
  Gene Symbol: ARAP2;
  Gene Name: ArfGAP with RhoGAP domain, ankyrin repeat and PH domain 2;
  ENSP ID: ENSP00000422731
MSSVSEVNVDIKDFLMSINLEQYLLHFHESGFTTVKDCAAINDSLLQ

SEQ ID NO: 6137 - protein, 50 aa, Homo sapiens
  Payload ID: 1333;
  Gene Symbol: ARAP2;
  Gene Name: ArfGAP with RhoGAP domain, ankyrin repeat and PH domain 2;
  ENSP ID: ENSP00000423886
MLIHQPFLHRQYLPMPAFMEHLQRRLNQDGWINSLLKGNLILNKPKQITS

SEQ ID NO: 6138 - protein, 863 aa, Homo sapiens
  Payload ID: 1333;
  Gene Symbol: ARAP2;
  Gene Name: ArfGAP with RhoGAP domain, ankyrin repeat and PH domain 2;
  ENSP ID: ENSP00000481036
MDASIWSNELIELFIVIGNKRANDFWAGNLQKDEELHMDSPVEKRKNFITQKYKEGKFRKTLLASLTKEELNKALCAAVVKPDVLETMALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSQAQRKWTEAIAKHFVPLFAENLTEADYDLIGQLFYKDCHALDQWRKGWFAMDKSSLHFCLQMQEVQGDRMHLRRLQELTISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEVKEDQVKQMDIENSFITKWKDTQVSQAGDLLIEVYVERKEPDCSIIIRISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTSWGLTAYSEKHHWHLCCDSSRTQTEWMTSIFIAQHEYDIWPPAGKERKRSITKNPKIGGLPLIPIQHEGNATLARKILRVQEQNLKGCGSVKSVIKSPWTLA

SEQ ID NO: 6139 - protein, 1544 aa, Homo sapiens
  Payload ID: 1334;
  Gene Symbol: ARAP3;
  Gene Name: ArfGAP with RhoGAP domain, ankyrin repeat and PH domain 3;
  Uniprot ID:  Q8WWN8;
  ENSP ID: ENSP00000239440
MAAPQDLDIAVWLATVHLEQYADTFRRHGLATAGAARGLGHEELKQLGISATGHRKRILRLLQTGTEEGSLDPKSDSAMEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEGEEPWFPPAPDGSCPGLLPSDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 6140 - protein, 473 aa, Homo sapiens
  Payload ID: 1334;
  Gene Symbol: ARAP3;
  Gene Name: ArfGAP with RhoGAP domain, ankyrin repeat and PH domain 3;
  ENSP ID: ENSP00000421148
MAAPQDLDIAVWLATVHLEQYADTFRRHGLATAGAARGLGHEELKQLGISATGHRKRILRLLQTGTEEGSLDPKSDSAMEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQS

SEQ ID NO: 6141 - protein, 1193 aa, Homo sapiens
  Payload ID: 1334;
  Gene Symbol: ARAP3;
  Gene Name: ArfGAP with RhoGAP domain, ankyrin repeat and PH domain 3;
  Uniprot ID:  Q8WWN8;
  ENSP ID: ENSP00000421468
MTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEGEEPWFPPAPDGSCPGLLPSDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 6142 - protein, 1375 aa, Homo sapiens
  Payload ID: 1334;
  Gene Symbol: ARAP3;
  Gene Name: ArfGAP with RhoGAP domain, ankyrin repeat and PH domain 3;
  ENSP ID: ENSP00000421826
MEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 6143 - protein, 1375 aa, Homo sapiens; identical to SEQ ID NO: 6142
  Payload ID: 1334;
  Gene Symbol: ARAP3;
  Gene Name: ArfGAP with RhoGAP domain, ankyrin repeat and PH domain 3;
  ENSP ID: ENSP00000486980

SEQ ID NO: 6144 - protein, 1122 aa, Homo sapiens
  Payload ID: 1335;
  Gene Symbol: ASAP1;
  Gene Name: ArfGAP with SH3 domain, ankyrin repeat and PH domain 1;
  ENSP ID: ENSP00000350297
MVSNLKRIMAQKWMPDQISVSEFIAETTEDYNSPTTSSFTTRLHNCRNTVTLLEEALDQDRTALQKVKKSVKAIYNSGQDHVQNEENYAQVLDKFGSNFLSRDNPDLGTAFVKFSTLTKELSTLLKNLLQGLSHNVIFTLDSLLKGDLKGVKGDLKKPFDKAWKDYETKFTKIEKEKREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKEDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPIKKERSPRPQSFCHSSSISPQDKLALPGFSTPRDKQRLSYGAFTNQIFVSTSTDSPTSPTTEAPPLPPRNAGKGPTGPPSTLPLSTQTSSGSSTLSKKRPPPPPPGHKRTLSDPPSPLPHGPPNKGAVPWGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHILSD

SEQ ID NO: 6145 - protein, 39 aa, Homo sapiens
  Payload ID: 1335;
  Gene Symbol: ASAP1;
  Gene Name: ArfGAP with SH3 domain, ankyrin repeat and PH domain 1;
  ENSP ID: ENSP00000428463
MRSSASRLSSFSSRDSLWNRYPGMIFRVFEKMRGADGFH

SEQ ID NO: 6146 - protein, 39 aa, Homo sapiens; identical to SEQ ID NO: 6145
  Payload ID: 1335;
  Gene Symbol: ASAP1;
  Gene Name: ArfGAP with SH3 domain, ankyrin repeat and PH domain 1;
  ENSP ID: ENSP00000428629

SEQ ID NO: 6147 - protein, 33 aa, Homo sapiens
  Payload ID: 1335;
  Gene Symbol: ASAP1;
  Gene Name: ArfGAP with SH3 domain, ankyrin repeat and PH domain 1;
  ENSP ID: ENSP00000428936
MIRTEITGAEIAEEMEKERRLFQLQMCEYLIKV

SEQ ID NO: 6148 - protein, 950 aa, Homo sapiens
  Payload ID: 1335;
  Gene Symbol: ASAP1;
  Gene Name: ArfGAP with SH3 domain, ankyrin repeat and PH domain 1;
  ENSP ID: ENSP00000429391
  MOD_RES (1)..(1): Any amino acid
XKREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKESRRDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPIKKERSPRPQSFCHSSSISPQDKLALPGFSTPRDKQRLSYGAFTNQIFVSTSTDSPTSPTTEAPPLPPRNAGKGPTGPPSTLPLSTQTSSGSSTLSKKRPPPPPPGHKRTLSDPPSPLPHGPPNKGAVPWGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHILSD

SEQ ID NO: 6149 - protein, 39 aa, Homo sapiens; identical to SEQ ID NO: 6145
  Payload ID: 1335;
  Gene Symbol: ASAP1;
  Gene Name: ArfGAP with SH3 domain, ankyrin repeat and PH domain 1;
  ENSP ID: ENSP00000429614

SEQ ID NO: 6150 - protein, 483 aa, Homo sapiens
  Payload ID: 1335;
  Gene Symbol: ASAP1;
  Gene Name: ArfGAP with SH3 domain, ankyrin repeat and PH domain 1;
  ENSP ID: ENSP00000429829
  MOD_RES (1)..(1): Any amino acid
XELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPIKKERSPRPQSFCHSSSISPQDKLALPGFSTPRDKQRLSYGAFTNQIFVSTSTDSPTSPTTEAPPLPPRNAGKGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHI

SEQ ID NO: 6151 - protein, 1129 aa, Homo sapiens
  Payload ID: 1335;
  Gene Symbol: ASAP1;
  Gene Name: ArfGAP with SH3 domain, ankyrin repeat and PH domain 1;
  Uniprot ID:  Q9ULH1;
  ENSP ID: ENSP00000429900
MRSSASRLSSFSSRDSLWNRMPDQISVSEFIAETTEDYNSPTTSSFTTRLHNCRNTVTLLEEALDQDRTALQKVKKSVKAIYNSGQDHVQNEENYAQVLDKFGSNFLSRDNPDLGTAFVKFSTLTKELSTLLKNLLQGLSHNVIFTLDSLLKGDLKGVKGDLKKPFDKAWKDYETKFTKIEKEKREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKEDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPIKKERSPRPQSFCHSSSISPQDKLALPGFSTPRDKQRLSYGAFTNQIFVSTSTDSPTSPTTEAPPLPPRNAGKGPTGPPSTLPLSTQTSSGSSTLSKKRPPPPPPGHKRTLSDPPSPLPHGPPNKGAVPWGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHILSD

SEQ ID NO: 6152 - protein, 98 aa, Homo sapiens
  Payload ID: 1335;
  Gene Symbol: ASAP1;
  Gene Name: ArfGAP with SH3 domain, ankyrin repeat and PH domain 1;
  ENSP ID: ENSP00000430917
MVSNLKRIMAQKWMPDQISVSEFIAETTEDYNSPTTSSFTTRLHNCRNTVTLLEEALDQDRTALQKVKKSVKAIYNSGQDHVQNEENYAQVLDKFGSN

SEQ ID NO: 6153 - protein, 1006 aa, Homo sapiens
  Payload ID: 1336;
  Gene Symbol: ASAP2;
  Gene Name: ArfGAP with SH3 domain, ankyrin repeat and PH domain 2;
  Uniprot ID:  O43150;
  ENSP ID: ENSP00000281419
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKVQTASSANTLWKTNSVSVDGGSRQRSSSDPPAVHPPLPPLRVTSTNPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 6154 - protein, 961 aa, Homo sapiens
  Payload ID: 1336;
  Gene Symbol: ASAP2;
  Gene Name: ArfGAP with SH3 domain, ankyrin repeat and PH domain 2;
  Uniprot ID:  O43150;
  ENSP ID: ENSP00000316404
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKDPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 6155 - protein, 903 aa, Homo sapiens
  Payload ID: 1337;
  Gene Symbol: ASAP3;
  Gene Name: ArfGAP with SH3 domain, ankyrin repeat and PH domain 3;
  Uniprot ID:  Q8TDY4;
  ENSP ID: ENSP00000338769
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPGEVAQDMQRERRIFQLHMCEYLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDGIRRVWQKRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 6156 - protein, 894 aa, Homo sapiens
  Payload ID: 1337;
  Gene Symbol: ASAP3;
  Gene Name: ArfGAP with SH3 domain, ankyrin repeat and PH domain 3;
  Uniprot ID:  Q8TDY4;
  ENSP ID: ENSP00000408826
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQASLSLGSRAKLEKERDRARVTGGIPGEVAQDMQRERRIFQLHMCEYLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDGIRRVWQKRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 6157 - protein, 124 aa, Homo sapiens
  Payload ID: 1337;
  Gene Symbol: ASAP3;
  Gene Name: ArfGAP with SH3 domain, ankyrin repeat and PH domain 3;
  ENSP ID: ENSP00000434897
  MOD_RES (1)..(1): Any amino acid
XRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQVRTPPRATYNPPV

SEQ ID NO: 6158 - protein, 203 aa, Homo sapiens
  Payload ID: 1337;
  Gene Symbol: ASAP3;
  Gene Name: ArfGAP with SH3 domain, ankyrin repeat and PH domain 3;
  ENSP ID: ENSP00000435394
LEQAQAGTFAFPLHVDYSWVISTEPGSDSEEDEEEKRCLLKLPAQAHWASGRLDISNKTYETVASLGAATPQGENRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 6159 - protein, 44 aa, Homo sapiens
  Payload ID: 1337;
  Gene Symbol: ASAP3;
  Gene Name: ArfGAP with SH3 domain, ankyrin repeat and PH domain 3;
  ENSP ID: ENSP00000435858
MPEQFSVAEFLAVTAEDLSSPAGAAAFAAKMPRSWKETKPSCRE

SEQ ID NO: 6160 - protein, 407 aa, Homo sapiens
  Payload ID: 1337;
  Gene Symbol: ASAP3;
  Gene Name: ArfGAP with SH3 domain, ankyrin repeat and PH domain 3;
  Uniprot ID:  Q8TDY4;
  ENSP ID: ENSP00000436150
MGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 6161 - protein, 120 aa, Homo sapiens
  Payload ID: 1337;
  Gene Symbol: ASAP3;
  Gene Name: ArfGAP with SH3 domain, ankyrin repeat and PH domain 3;
  ENSP ID: ENSP00000436439
YLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDG

SEQ ID NO: 6162 - protein, 157 aa, Homo sapiens
  Payload ID: 1337;
  Gene Symbol: ASAP3;
  Gene Name: ArfGAP with SH3 domain, ankyrin repeat and PH domain 3;
  ENSP ID: ENSP00000476400
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAK

SEQ ID NO: 6163 - protein, 202 aa, Homo sapiens
  Payload ID: 1337;
  Gene Symbol: ASAP3;
  Gene Name: ArfGAP with SH3 domain, ankyrin repeat and PH domain 3;
  ENSP ID: ENSP00000483740
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPGNLGIPAKPHPTLKRASESPQAPPDPA

SEQ ID NO: 6164 - protein, 407 aa, Homo sapiens; identical to SEQ ID NO: 6160
  Payload ID: 1337;
  Gene Symbol: ASAP3;
  Gene Name: ArfGAP with SH3 domain, ankyrin repeat and PH domain 3;
  ENSP ID: ENSP00000488934

SEQ ID NO: 6165 - protein, 903 aa, Homo sapiens; identical to SEQ ID NO: 6155
  Payload ID: 1337;
  Gene Symbol: ASAP3;
  Gene Name: ArfGAP with SH3 domain, ankyrin repeat and PH domain 3;
  ENSP ID: ENSP00000488946

SEQ ID NO: 6166 - protein, 894 aa, Homo sapiens; identical to SEQ ID NO: 6156
  Payload ID: 1337;
  Gene Symbol: ASAP3;
  Gene Name: ArfGAP with SH3 domain, ankyrin repeat and PH domain 3;
  ENSP ID: ENSP00000488953

SEQ ID NO: 6167 - protein, 120 aa, Homo sapiens; identical to SEQ ID NO: 6161
  Payload ID: 1337;
  Gene Symbol: ASAP3;
  Gene Name: ArfGAP with SH3 domain, ankyrin repeat and PH domain 3;
  ENSP ID: ENSP00000489094

SEQ ID NO: 6168 - protein, 157 aa, Homo sapiens; identical to SEQ ID NO: 6162
  Payload ID: 1337;
  Gene Symbol: ASAP3;
  Gene Name: ArfGAP with SH3 domain, ankyrin repeat and PH domain 3;
  ENSP ID: ENSP00000489187

SEQ ID NO: 6169 - protein, 124 aa, Homo sapiens; identical to SEQ ID NO: 6157
  Payload ID: 1337;
  Gene Symbol: ASAP3;
  Gene Name: ArfGAP with SH3 domain, ankyrin repeat and PH domain 3;
  ENSP ID: ENSP00000489344
  MOD_RES (1)..(1): Any amino acid

SEQ ID NO: 6170 - protein, 202 aa, Homo sapiens; identical to SEQ ID NO: 6163
  Payload ID: 1337;
  Gene Symbol: ASAP3;
  Gene Name: ArfGAP with SH3 domain, ankyrin repeat and PH domain 3;
  ENSP ID: ENSP00000489432

SEQ ID NO: 6171 - protein, 203 aa, Homo sapiens; identical to SEQ ID NO: 6158
  Payload ID: 1337;
  Gene Symbol: ASAP3;
  Gene Name: ArfGAP with SH3 domain, ankyrin repeat and PH domain 3;
  ENSP ID: ENSP00000489483

SEQ ID NO: 6172 - protein, 44 aa, Homo sapiens; identical to SEQ ID NO: 6159
  Payload ID: 1337;
  Gene Symbol: ASAP3;
  Gene Name: ArfGAP with SH3 domain, ankyrin repeat and PH domain 3;
  ENSP ID: ENSP00000489485

SEQ ID NO: 6173 - protein, 2177 aa, Homo sapiens
  Payload ID: 1338;
  Gene Symbol: ARFGEF3;
  Gene Name: ARFGEF family member 3;
  Uniprot ID:  Q5TH69;
  ENSP ID: ENSP00000251691
MEEILRKLQKEASGSKYKAIKESCTWALETLGGLDTIVKIPPHVLREKCLLPLQLALESKNVKLAQHALAGMQKLLSEERFVSMETDSDEKQLLNQILNAVKVTPSLNEDLQVEVMKVLLCITYTPTFDLNGSAVLKIAEVCIETYISSCHQRSINTAVRATLSQMLSDLTLQLRQRQENTIIENPDVPQDFGNQGSTVESLCDDVVSVLTVLCEKLQAAINDSQQLQLLYLECILSVLSSSSSSMHLHRRFTDLIWKNLCPALIVILGNPIHDKTITSAHTSSTSTSLESDSASPGVSDHGRGSGCSCTAPALSGPVARTIYYIAAELVRLVGSVDSMKPVLQSLYHRVLLYPPPQHRVEAIKIMKEILGSPQRLCDLAGPSSTESESRKRSISKRKSHLDLLKLIMDGMTEACIKGGIEACYAAVSCVCTLLGALDELSQGKGLSEGQVQLLLLRLEELKDGAEWSRDSMEINEADFRWQRRVLSSEHTPWESGNERSLDISISVTTDTGQTTLEGELGQTTPEDHSGNHKNSLKSPAIPEGKETLSKVLETEAVDQPDVVQRSHTVPYPDITNFLSVDCRTRSYGSRYSESNFSVDDQDLSRTEFDSCDQYSMAAEKDSGRSDVSDIGSDNCSLADEEQTPRDCLGHRSLRTAALSLKLLKNQEADQHSARLFIQSLEGLLPRLLSLSNVEEVDTALQNFASTFCSGMMHSPGFDGNSSLSFQMLMNADSLYTAAHCALLLNLKLSHGDYYRKRPTLAPGVMKDFMKQVQTSGVLMVFSQAWIEELYHQVLDRNMLGEAGYWGSPEDNSLPLITMLTDIDGLESSAIGGQLMASAATESPFAQSRRIDDSTVAGVAFARYILVGCWKNLIDTLSTPLTGRMAGSSKGLAFILGAEGIKEQNQKERDAICMSLDGLRKAARLSCALGVAANCASALAQMAAASCVQEEKEEREAQEPSDAITQVKLKVEQKLEQIGKVQGVWLHTAHVLCMEAILSVGLEMGSHNPDCWPHVFRVCEYVGTLEHNHFSDGASQPPLTISQPQKATGSAGLLGDPECEGSPPEHSPEQGRSLSTAPVVQPLSIQDLVREGSRGRASDFRGGSLMSGSSAAKVVLTLSTQADRLFEDATDKLNLMALGGFLYQLKKASQSQLFHSVTDTVDYSLAMPGEVKSTQDRKSALHLFRLGNAMLRIVRSKARPLLHVMRCWSLVAPHLVEAACHKERHVSQKAVSFIHDILTEVLTDWNEPPHFHFNEALFRPFERIMQLELCDEDVQDQVVTSIGELVEVCSTQIQSGWRPLFSALETVHGGNKSEMKEYLVGDYSMGKGQAPVFDVFEAFLNTDNIQVFANAATSYIMCLMKFVKGLGEVDCKEIGDCAPAPGAPSTDLCLPALDYLRRCSQLLAKIYKMPLKPIFLSGRLAGLPRRLQEQSASSEDGIESVLSDFDDDTGLIEVWIILLEQLTAAVSNCPRQHQPPTLDLLFELLRDVTKTPGPGFGIYAVVHLLLPVMSVWLRRSHKDHSYWDMASANFKHAIGLSCELVVEHIQSFLHSDIRYESMINTMLKDLFELLVACVAKPTETISRVGCSCIRYVLVTAGPVFTEEMWRLACCALQDAFSATLKPVKDLLGCFHSGTESFSGEGCQVRVAAPSSSPSAEAEYWRIRAMAQQVFMLDTQCSPKTPNNFDHAQSCQLIIELPPDEKPNGHTKKSVSFREIVVSLLSHQVLLQNLYDILLEEFVKGPSPGEEKTIQVPEAKLAGFLRYISMQNLAVIFDLLLDSYRTAREFDTSPGLKCLLKKVSGIGGAANLYRQSAMSFNIYFHALVCAVLTNQETITAEQVKKVLFEDDERSTDSSQQCSSEDEDIFEETAQVSPPRGKEKRQWRARMPLLSVQPVSNADWVWLVKRLHKLCMELCNNYIQMHLDLENCMEEPPIFKGDPFFILPSFQSESSTPSTGGFSGKETPSEDDRSQSREHMGESLSLKAGGGDLLLPPSPKVEKKDPSRKKEWWENAGNKIYTMAADKTISKLMTEYKKRKQQHNLSAFPKEVKVEKKGEPLGPRGQDSPLLQRPQHLMDQGQMRHSFSAGPELLRQDKRPRSGSTGSSLSVSVRDAEAQIQAWTNMVLTVLNQIQILPDQTFTALQPAVFPCISQLTCHVTDIRVRQAVREWLGRVGRVYDIIV

SEQ ID NO: 6174 - protein, 330 aa, Homo sapiens
  Payload ID: 1339;
  Gene Symbol: ARG1;
  Gene Name: arginase 1;
  Uniprot ID:  P05089;
  ENSP ID: ENSP00000349446
MSAKSRTIGIIGAPFSKGQPRGGVEEGPTVLRKAGLLEKLKEQVTQNFLILECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 6175 - protein, 322 aa, Homo sapiens
  Payload ID: 1339;
  Gene Symbol: ARG1;
  Gene Name: arginase 1;
  Uniprot ID:  P05089;
  ENSP ID: ENSP00000357066
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 6176 - protein, 354 aa, Homo sapiens
  Payload ID: 1340;
  Gene Symbol: ARG2;
  Gene Name: arginase 2;
  Uniprot ID:  P78540;
  ENSP ID: ENSP00000261783
MSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTREGGHIVYDQLPTPSSPDESENQARVRI

SEQ ID NO: 6177 - protein, 68 aa, Homo sapiens
  Payload ID: 1341;
  Gene Symbol: ARGLU1;
  Gene Name: arginine and glutamate rich 1;
  ENSP ID: ENSP00000353844
MKLNEKFSEGWRKPNASWKSSCSKNSSDRDKLSLPHKKLERGSWRVWQPRSTLCRTLDKTEEERAKRE

SEQ ID NO: 6178 - protein, 142 aa, Homo sapiens
  Payload ID: 1341;
  Gene Symbol: ARGLU1;
  Gene Name: arginine and glutamate rich 1;
  ENSP ID: ENSP00000365092
MKLNEKFSEGWRKPNASWKSSCSKNSSDRDKLSLPHKKLERGSWRVWQPRSTLCRTLDKTEEERAKREELERILEENNRKIAEAQAKLAEEQLRIVEEQRKIHEERMKLEQERQRQQKEEQKIILGKGKSRPKLSFSLKTQD

SEQ ID NO: 6179 - protein, 273 aa, Homo sapiens
  Payload ID: 1341;
  Gene Symbol: ARGLU1;
  Gene Name: arginine and glutamate rich 1;
  Uniprot ID:  Q9NWB6;
  ENSP ID: ENSP00000383059
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREEEERAKREELERILEENNRKIAEAQAKLAEEQLRIVEEQRKIHEERMKLEQERQRQQKEEQKIILGKGKSRPKLSFSLKTQD

SEQ ID NO: 6180 - protein, 164 aa, Homo sapiens
  Payload ID: 1342;
  Gene Symbol: AVP;
  Gene Name: arginine vasopressin;
  Uniprot ID:  P01185;
  ENSP ID: ENSP00000369647
MPDTMLPACFLGLLAFSSACYFQNCPRGGKRAMSDLELRQCLPCGPGGKGRCFGPSICCADELGCFVGTAEALRCQEENYLPSPCQSGQKACGSGGRCAAFGVCCNDESCVTEPECREGFHRRARASDRSNATQLDGPAGALLLRLVQLAGAPEPFEPAQPDAY

SEQ ID NO: 6181 - protein, 418 aa, Homo sapiens
  Payload ID: 1343;
  Gene Symbol: AVPR1A;
  Gene Name: arginine vasopressin receptor 1A;
  Uniprot ID:  P37288;
  ENSP ID: ENSP00000299178
MRLSAGPDAGPSGNSSPWWPLATGAGNTSREAEALGEGNGPPRDVRNEELAKLEIAVLAVTFAVAVLGNSSVLLALHRTPRKTSRMHLFIRHLSLADLAVAFFQVLPQMCWDITYRFRGPDWLCRVVKHLQVFGMFASAYMLVVMTADRYIAVCHPLKTLQQPARRSRLMIAAAWVLSFVLSTPQYFVFSMIEVNNVTKARDCWATFIQPWGSRAYVTWMTGGIFVAPVVILGTCYGFICYNIWCNVRGKTASRQSKGAEQAGVAFQKGFLLAPCVSSVKSISRAKIRTVKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTGMWKDSPKSSKSIKFIPVST

SEQ ID NO: 6182 - protein, 186 aa, Homo sapiens
  Payload ID: 1343;
  Gene Symbol: AVPR1A;
  Gene Name: arginine vasopressin receptor 1A;
  ENSP ID: ENSP00000449822
MTGGIFVAPVVILGTCYGFICYNIWCNVRGKTASRQSKGAEQAGVAFQKGFLLAPCVSSVKSISRAKIRTVKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTDKKMRTG

SEQ ID NO: 6183 - protein, 424 aa, Homo sapiens
  Payload ID: 1344;
  Gene Symbol: AVPR1B;
  Gene Name: arginine vasopressin receptor 1B;
  Uniprot ID:  P47901;
  ENSP ID: ENSP00000356094
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTVKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 6184 - protein, 371 aa, Homo sapiens
  Payload ID: 1345;
  Gene Symbol: AVPR2;
  Gene Name: arginine vasopressin receptor 2;
  Uniprot ID:  P30518;
  ENSP ID: ENSP00000338072
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 6185 - protein, 371 aa, Homo sapiens; identical to SEQ ID NO: 6184
  Payload ID: 1345;
  Gene Symbol: AVPR2;
  Gene Name: arginine vasopressin receptor 2;
  Uniprot ID:  P30518;
  ENSP ID: ENSP00000351805

SEQ ID NO: 6186 - protein, 309 aa, Homo sapiens
  Payload ID: 1345;
  Gene Symbol: AVPR2;
  Gene Name: arginine vasopressin receptor 2;
  Uniprot ID:  P30518;
  ENSP ID: ENSP00000359066
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGGCSRG

SEQ ID NO: 6187 - protein, 48 aa, Homo sapiens
  Payload ID: 1345;
  Gene Symbol: AVPR2;
  Gene Name: arginine vasopressin receptor 2;
  ENSP ID: ENSP00000393397
MLMASTTSACPSSSSSPSATWKVAAGSLTAGPALRSPGAVAPMSPGLP

SEQ ID NO: 6188 - protein, 372 aa, Homo sapiens
  Payload ID: 1345;
  Gene Symbol: AVPR2;
  Gene Name: arginine vasopressin receptor 2;
  ENSP ID: ENSP00000393513
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLGRPLCYSCCWPASTAAPTPGSMHLSAAACPQSCEACSAVPGDAPHPAWVPKMSPAPPPAPPWPRTLHREELLGVLPLEALRSSAAFLGLVLGATGRGT

SEQ ID NO: 6189 - protein, 147 aa, Homo sapiens
  Payload ID: 1346;
  Gene Symbol: AVPI1;
  Gene Name: arginine vasopressin-induced 1;
  Uniprot ID:  Q5T686;
  ENSP ID: ENSP00000359660
MGTPASVVSEPPPWQAPIEARGRKQASANIFQDAELLQIQALFQRSGDQLAEERAQIIWECAGDHRVAEALKRLRRKRPPRQKPLGHSLHHCSRLRILEPHSALANPQSATETASSEQYLHSRKKSARIRRNWRKSGPTSYLHQIRH

SEQ ID NO: 6190 - protein, 334 aa, Homo sapiens
  Payload ID: 1347;
  Gene Symbol: RSRC1;
  Gene Name: arginine/serine-rich coiled-coil 1;
  Uniprot ID:  Q96IZ7;
  ENSP ID: ENSP00000295930
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 6191 - protein, 276 aa, Homo sapiens
  Payload ID: 1347;
  Gene Symbol: RSRC1;
  Gene Name: arginine/serine-rich coiled-coil 1;
  Uniprot ID:  Q96IZ7;
  ENSP ID: ENSP00000308671
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNLFIEKADAEEKWFKRLIALRQERLMGSPVA

SEQ ID NO: 6192 - protein, 203 aa, Homo sapiens
  Payload ID: 1347;
  Gene Symbol: RSRC1;
  Gene Name: arginine/serine-rich coiled-coil 1;
  ENSP ID: ENSP00000417302
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKA

SEQ ID NO: 6193 - protein, 164 aa, Homo sapiens
  Payload ID: 1347;
  Gene Symbol: RSRC1;
  Gene Name: arginine/serine-rich coiled-coil 1;
  ENSP ID: ENSP00000417690
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKR

SEQ ID NO: 6194 - protein, 283 aa, Homo sapiens
  Payload ID: 1347;
  Gene Symbol: RSRC1;
  Gene Name: arginine/serine-rich coiled-coil 1;
  ENSP ID: ENSP00000417816
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKLFIEKADAEEKWFKRLIALRQERLMGSPVA

SEQ ID NO: 6195 - protein, 112 aa, Homo sapiens
  Payload ID: 1347;
  Gene Symbol: RSRC1;
  Gene Name: arginine/serine-rich coiled-coil 1;
  ENSP ID: ENSP00000419054
  MOD_RES (1)..(1): Any amino acid
XKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRYPPTSTSWVAGTTGTHRHTQL

SEQ ID NO: 6196 - protein, 194 aa, Homo sapiens
  Payload ID: 1347;
  Gene Symbol: RSRC1;
  Gene Name: arginine/serine-rich coiled-coil 1;
  ENSP ID: ENSP00000419394
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGESGNIKAGLEHLPPAEQAKARLQLVLEAA

SEQ ID NO: 6197 - protein, 276 aa, Homo sapiens; identical to SEQ ID NO: 6191
  Payload ID: 1347;
  Gene Symbol: RSRC1;
  Gene Name: arginine/serine-rich coiled-coil 1;
  Uniprot ID:  Q96IZ7;
  ENSP ID: ENSP00000419794

SEQ ID NO: 6198 - protein, 199 aa, Homo sapiens
  Payload ID: 1347;
  Gene Symbol: RSRC1;
  Gene Name: arginine/serine-rich coiled-coil 1;
  ENSP ID: ENSP00000420018
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRDKEKREKEKDKGKDKELHNIKRGFHQKNCERKKKLTSNRKRKVLGRPNWNLETSKLD

SEQ ID NO: 6199 - protein, 334 aa, Homo sapiens; identical to SEQ ID NO: 6190
  Payload ID: 1347;
  Gene Symbol: RSRC1;
  Gene Name: arginine/serine-rich coiled-coil 1;
  Uniprot ID:  Q96IZ7;
  ENSP ID: ENSP00000420150

SEQ ID NO: 6200 - protein, 208 aa, Homo sapiens
  Payload ID: 1347;
  Gene Symbol: RSRC1;
  Gene Name: arginine/serine-rich coiled-coil 1;
  ENSP ID: ENSP00000420464
  MOD_RES (1)..(1): Any amino acid
XSRSRPRLRSHSRSSERSSHRRTRSRSRDRERRKGRDKEKREKEKDKGKDKELHNIKRGESGNIKAGLEHLPPAEQAKARLQLVLEAAAKADEALKAKERNEEEAKRRKEEDQATLVEQVKRVKEIEAIESDSFVQQTFRSSKEVKKSVEPSEVKQATSTSGPASAVADPPSTEKEIDPTSIPTAIKYQDDNSLAHPNVISLNFTNVS

SEQ ID NO: 6201 - protein, 334 aa, Homo sapiens; identical to SEQ ID NO: 6190
  Payload ID: 1347;
  Gene Symbol: RSRC1;
  Gene Name: arginine/serine-rich coiled-coil 1;
  Uniprot ID:  Q96IZ7;
  ENSP ID: ENSP00000481697

SEQ ID NO: 6202 - protein, 434 aa, Homo sapiens
  Payload ID: 1348;
  Gene Symbol: RSRC2;
  Gene Name: arginine/serine-rich coiled-coil 2;
  Uniprot ID:  Q7L4I2;
  ENSP ID: ENSP00000330188
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAATGGSVLNVAALLASGTQVTPQIAMAAQMAALQAKALAETGIAVPSYYNPAAVNPMKFAEQEKKRKMLWQGKKEGDKSQSAEIWEKLNFGNKDQNVKFRKLMGIKSEDEAGCSSVDEESYKTLKQQEEVFRNLDAQYEMARSQTHTQRGMGLGFTSSMRGMDAV

SEQ ID NO: 6203 - protein, 236 aa, Homo sapiens
  Payload ID: 1348;
  Gene Symbol: RSRC2;
  Gene Name: arginine/serine-rich coiled-coil 2;
  ENSP ID: ENSP00000343315
MIRTNFFLKQGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAATGGSVLNVAALLASGTQVTPQIAM

SEQ ID NO: 6204 - protein, 76 aa, Homo sapiens
  Payload ID: 1348;
  Gene Symbol: RSRC2;
  Gene Name: arginine/serine-rich coiled-coil 2;
  ENSP ID: ENSP00000412148
MAASDTERDGLAPEKTSPDRDKKKEQSEVSVSPRASKHHYSRSRSRSRERKRKSDNEGRKHRSRSRSKERAYARRD

SEQ ID NO: 6205 - protein, 76 aa, Homo sapiens; identical to SEQ ID NO: 6204
  Payload ID: 1348;
  Gene Symbol: RSRC2;
  Gene Name: arginine/serine-rich coiled-coil 2;
  ENSP ID: ENSP00000432725

SEQ ID NO: 6206 - protein, 76 aa, Homo sapiens; identical to SEQ ID NO: 6204
  Payload ID: 1348;
  Gene Symbol: RSRC2;
  Gene Name: arginine/serine-rich coiled-coil 2;
  ENSP ID: ENSP00000436515

SEQ ID NO: 6207 - protein, 176 aa, Homo sapiens
  Payload ID: 1348;
  Gene Symbol: RSRC2;
  Gene Name: arginine/serine-rich coiled-coil 2;
  ENSP ID: ENSP00000444159
  MOD_RES (1)..(1): Any amino acid
XRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRQNT

SEQ ID NO: 6208 - protein, 25 aa, Homo sapiens
  Payload ID: 1348;
  Gene Symbol: RSRC2;
  Gene Name: arginine/serine-rich coiled-coil 2;
  ENSP ID: ENSP00000445664
MKEENTGAGAEAKSVLMREETELKT

SEQ ID NO: 6209 - protein, 91 aa, Homo sapiens
  Payload ID: 1348;
  Gene Symbol: RSRC2;
  Gene Name: arginine/serine-rich coiled-coil 2;
  ENSP ID: ENSP00000446470
MVRTGTNAKKESHQEAEVTQDLGLVKDAIVVEAGSGRSLDPGVGSGRNRDPEAERGRNRDPEAGKENGGSGLVPAQDQDTGIGLEAGVGQG

SEQ ID NO: 6210 - protein, 290 aa, Homo sapiens
  Payload ID: 1349;
  Gene Symbol: RSRP1;
  Gene Name: arginine/serine-rich prt 1;
  Uniprot ID:  Q9BUV0;
  ENSP ID: ENSP00000243189
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPELSEKVTEDGTRNPNEKPTQQRSIAFSSNNSVAKPIQKSAKAATEEASSRSPKIDQKKSPYGLWIPI

SEQ ID NO: 6211 - protein, 242 aa, Homo sapiens
  Payload ID: 1349;
  Gene Symbol: RSRP1;
  Gene Name: arginine/serine-rich prt 1;
  Uniprot ID:  Q9BUV0;
  ENSP ID: ENSP00000391510
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPEVSILGLSEQNFQKANCQI

SEQ ID NO: 6212 - protein, 84 aa, Homo sapiens
  Payload ID: 1349;
  Gene Symbol: RSRP1;
  Gene Name: arginine/serine-rich prt 1;
  ENSP ID: ENSP00000454463
  MOD_RES (1)..(1): Any amino acid
XRTVYPEEHSRWRDRSRTRSRSRTPFRLSEKDRMELLEIAKTNAAKALGTTNIDLPASLRTVPSAKETSRGIGVSSNGAKPEKS

SEQ ID NO: 6213 - protein, 129 aa, Homo sapiens
  Payload ID: 1349;
  Gene Symbol: RSRP1;
  Gene Name: arginine/serine-rich prt 1;
  ENSP ID: ENSP00000454590
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGR

SEQ ID NO: 6214 - protein, 183 aa, Homo sapiens
  Payload ID: 1349;
  Gene Symbol: RSRP1;
  Gene Name: arginine/serine-rich prt 1;
  ENSP ID: ENSP00000455127
  MOD_RES (1)..(1): Any amino acid
XSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPELSEKVTEDGTRNPNEKPTQQRSIAFSSNNSVAKPIQKSAKAATEEASSRSPKIDQKKSPYGLWIPI

SEQ ID NO: 6215 - protein, 96 aa, Homo sapiens
  Payload ID: 1349;
  Gene Symbol: RSRP1;
  Gene Name: arginine/serine-rich prt 1;
  ENSP ID: ENSP00000456995
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRER

SEQ ID NO: 6216 - protein, 226 aa, Homo sapiens
  Payload ID: 1349;
  Gene Symbol: RSRP1;
  Gene Name: arginine/serine-rich prt 1;
  ENSP ID: ENSP00000457195
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPEMF

SEQ ID NO: 6217 - protein, 226 aa, Homo sapiens
  Payload ID: 1349;
  Gene Symbol: RSRP1;
  Gene Name: arginine/serine-rich prt 1;
  Uniprot ID:  Q9BUV0;
  ENSP ID: ENSP00000457582
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPEKS

SEQ ID NO: 6218 - protein, 89 aa, Homo sapiens
  Payload ID: 1349;
  Gene Symbol: RSRP1;
  Gene Name: arginine/serine-rich prt 1;
  ENSP ID: ENSP00000458042
MSNYVNDMWPGSPQEKDSPSTSRSGGSSRLSSRSRSRSFSRSSRSHSRVSSRFSSRSRRSKSRSRSRRRHQRKYRRYSRSYSRSRSRSR

SEQ ID NO: 6219 - protein, 315 aa, Homo sapiens
  Payload ID: 1350;
  Gene Symbol: ARGFX;
  Gene Name: arginine-fifty homeobox;
  Uniprot ID:  A6NJG6;
  ENSP ID: ENSP00000335578
MRNRMAPENPQPDPFINRNYSNMKVIPPQDPASPSFTLLSKLECSGTVSAYCSLNLPGSTDPPTSASRVAATTAIRRRHKERTSFTHQQYEELEALFSQTMFPDRNLQEKLALRLDLPESTVKVWFRNRRFKLKKQQQQQSAKQRNQILPSKKNVPTSPRTSPSPYAFSPVISDFYSSLPSQPLDPSNWAWNSTFTESSTSDFQMQDTQWERLVASVPALYSDAYDIFQIIELYNLPDENEISSSSFHCLYQYLSPTKYQVGGQGSSLSIFAGPAVGLSPAQTWPNMTSQAFEAYSLTDSLEFQKTSNMVDLGFL

SEQ ID NO: 6220 - protein, 1566 aa, Homo sapiens
  Payload ID: 1351;
  Gene Symbol: RERE;
  Gene Name: arginine-glutamic acid dipeptide (RE) repeats;
  Uniprot ID:  Q9P2R6;
  ENSP ID: ENSP00000338629
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 6221 - protein, 1298 aa, Homo sapiens
  Payload ID: 1351;
  Gene Symbol: RERE;
  Gene Name: arginine-glutamic acid dipeptide (RE) repeats;
  ENSP ID: ENSP00000366684
MDDPFSPCRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 6222 - protein, 584 aa, Homo sapiens
  Payload ID: 1351;
  Gene Symbol: RERE;
  Gene Name: arginine-glutamic acid dipeptide (RE) repeats;
  ENSP ID: ENSP00000383699
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTSTPYPRDLPGAIPPPMSAAHQLQAMHAQSAELQRLAMEQQWLHGHPHMHGGHLPSQEDYYSRLKKEGDKQL

SEQ ID NO: 6223 - protein, 1566 aa, Homo sapiens; identical to SEQ ID NO: 6220
  Payload ID: 1351;
  Gene Symbol: RERE;
  Gene Name: arginine-glutamic acid dipeptide (RE) repeats;
  Uniprot ID:  Q9P2R6;
  ENSP ID: ENSP00000383700

SEQ ID NO: 6224 - protein, 1012 aa, Homo sapiens
  Payload ID: 1351;
  Gene Symbol: RERE;
  Gene Name: arginine-glutamic acid dipeptide (RE) repeats;
  Uniprot ID:  Q9P2R6;
  ENSP ID: ENSP00000422246
MFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 6225 - protein, 91 aa, Homo sapiens
  Payload ID: 1351;
  Gene Symbol: RERE;
  Gene Name: arginine-glutamic acid dipeptide (RE) repeats;
  ENSP ID: ENSP00000423259
  MOD_RES (1)..(1): Any amino acid
XCVYIESRRPNTPYFICSIQDFKLSKRDHLLMNVKWYYRQSEVPDSVYQHLVQDRHNENDSGRELVITDPVIKNRELFISDYVDTYHAAAL

SEQ ID NO: 6226 - protein, 177 aa, Homo sapiens
  Payload ID: 1351;
  Gene Symbol: RERE;
  Gene Name: arginine-glutamic acid dipeptide (RE) repeats;
  ENSP ID: ENSP00000423451
MSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGSAGPVHPLVDPLTAGPHLARFPYPPGTLPNPLLGQPPHEHEMLRHPVFGTPYPRDLPGAIPPPMSAAHQLQAMH

SEQ ID NO: 6227 - protein, 89 aa, Homo sapiens
  Payload ID: 1351;
  Gene Symbol: RERE;
  Gene Name: arginine-glutamic acid dipeptide (RE) repeats;
  ENSP ID: ENSP00000464712
MPGVNDCDLLMYLRAARSMAAFAGMCDGGSTEDGCVAASRDDTTLNALNTLHESGYDAGKALQRLVKKPVPKLIEKCWTEDEVKRFVKG

SEQ ID NO: 6228 - protein, 26 aa, Homo sapiens
  Payload ID: 1351;
  Gene Symbol: RERE;
  Gene Name: arginine-glutamic acid dipeptide (RE) repeats;
  ENSP ID: ENSP00000464847
MFKPVKEEDDGLSGKHSMRTRRSRGS

SEQ ID NO: 6229 - protein, 213 aa, Homo sapiens
  Payload ID: 1351;
  Gene Symbol: RERE;
  Gene Name: arginine-glutamic acid dipeptide (RE) repeats;
  ENSP ID: ENSP00000465133
  MOD_RES (1)..(1): Any amino acid
XDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSVSPLGPWGSWQLLQFPGMCGGLSLPGGGSESLVYQTKSWRGAALPEAVACLWAGKSSLFSPSRGPRVASCSGFCSKLLASGSVQALQGPSCSPRLLLVVSLPLYQISAILNLQAL

SEQ ID NO: 6230 - protein, 35 aa, Homo sapiens
  Payload ID: 1351;
  Gene Symbol: RERE;
  Gene Name: arginine-glutamic acid dipeptide (RE) repeats;
  ENSP ID: ENSP00000465271
MTADKDKDKDKEKDRDRDRDREREKRDKARESENS

SEQ ID NO: 6231 - protein, 464 aa, Homo sapiens
  Payload ID: 1352;
  Gene Symbol: ASL;
  Gene Name: argininosuccinate lyase;
  Uniprot ID:  P04424;
  ENSP ID: ENSP00000307188
MASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 6232 - protein, 242 aa, Homo sapiens
  Payload ID: 1352;
  Gene Symbol: ASL;
  Gene Name: argininosuccinate lyase;
  ENSP ID: ENSP00000354710
MASEVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRV

SEQ ID NO: 6233 - protein, 438 aa, Homo sapiens
  Payload ID: 1352;
  Gene Symbol: ASL;
  Gene Name: argininosuccinate lyase;
  Uniprot ID:  P04424;
  ENSP ID: ENSP00000370219
MASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 6234 - protein, 444 aa, Homo sapiens
  Payload ID: 1352;
  Gene Symbol: ASL;
  Gene Name: argininosuccinate lyase;
  Uniprot ID:  P04424;
  ENSP ID: ENSP00000378740
MASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGREDKEAVFEVSDTMSAVLQVATGVISTLQIHQENMGQALSPDMLATDLAYYLVRKGMPFRQAHEASGKAVFMAETKGVALNQLSLQELQTISPLFSGDVICVWDYGHSVEQYGALGGTARSSVDWQIRQVRALLQAQQA

SEQ ID NO: 6235 - protein, 464 aa, Homo sapiens; identical to SEQ ID NO: 6231
  Payload ID: 1352;
  Gene Symbol: ASL;
  Gene Name: argininosuccinate lyase;
  Uniprot ID:  P04424;
  ENSP ID: ENSP00000378741

SEQ ID NO: 6236 - protein, 412 aa, Homo sapiens
  Payload ID: 1353;
  Gene Symbol: ASS1;
  Gene Name: argininosuccinate synthase 1;
  Uniprot ID:  P00966;
  ENSP ID: ENSP00000253004
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGFWHSPECEFVRHCIAKSQERVEGKVQVSVLKGQVYILGRESPLSLYNEELVSMNVQGDYEPTDATGFININSLRLKEYHRLQSKVTAK

SEQ ID NO: 6237 - protein, 412 aa, Homo sapiens; identical to SEQ ID NO: 6236
  Payload ID: 1353;
  Gene Symbol: ASS1;
  Gene Name: argininosuccinate synthase 1;
  Uniprot ID:  P00966;
  ENSP ID: ENSP00000361469

SEQ ID NO: 6238 - protein, 412 aa, Homo sapiens; identical to SEQ ID NO: 6236
  Payload ID: 1353;
  Gene Symbol: ASS1;
  Gene Name: argininosuccinate synthase 1;
  Uniprot ID:  P00966;
  ENSP ID: ENSP00000361471

SEQ ID NO: 6239 - protein, 198 aa, Homo sapiens
  Payload ID: 1353;
  Gene Symbol: ASS1;
  Gene Name: argininosuccinate synthase 1;
  ENSP ID: ENSP00000394212
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENP

SEQ ID NO: 6240 - protein, 179 aa, Homo sapiens
  Payload ID: 1353;
  Gene Symbol: ASS1;
  Gene Name: argininosuccinate synthase 1;
  ENSP ID: ENSP00000397785
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKVIAPWRMPEFYNRFKGRNDLMEYAKQHGIPIPVTPKNPWSMDENLMHISYEAGILENP

SEQ ID NO: 6241 - protein, 650 aa, Homo sapiens
  Payload ID: 1354;
  Gene Symbol: RNPEP;
  Gene Name: arginyl aminopeptidase (aminopeptidase B);
  Uniprot ID:  Q9H4A4;
  ENSP ID: ENSP00000295640
MASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 6242 - protein, 611 aa, Homo sapiens
  Payload ID: 1354;
  Gene Symbol: RNPEP;
  Gene Name: arginyl aminopeptidase (aminopeptidase B);
  ENSP ID: ENSP00000356255
MASGEHSPGSGAARRPLHSAQAVDVASASNFRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIPGFEFDRWLNTPGWPPYLPDLSPGDSLMKPAEELAQLWAAEELDMKAIEAVAISPWKTYQLVYFLDKILQKSPLPPGNVKKLGDTYPSISNARNAELRLRWGQIVLKNDHQEDFWKVKEFLHNQGKQKYTLPLYHAMMGGSEVAQTLAKETFASTASQLHSNVVNYVQQIVAPKGS

SEQ ID NO: 6243 - protein, 344 aa, Homo sapiens
  Payload ID: 1354;
  Gene Symbol: RNPEP;
  Gene Name: arginyl aminopeptidase (aminopeptidase B);
  ENSP ID: ENSP00000389602
MTCCSCTSLSALLDFWAEVCWLAPEQTAGKKKPFVYTQGQAVLNRAFFPCFDTPAVKYKYSALIEVPDGFTAVMSASTWEKRGPNKFFFQMCQPIPSYLIALAIGDLVSAEVGPRSRVWAEPCLIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGAAYTCLEAATGRALLRQHMDITGEENPLNKLRVKIEPGVDPDDTYNETPYEKGFCFVSYLAHLVGDQDQFDSFLKAYVHEFKFRSILADDFLDFYLEYFPELKKKRVDIIP

SEQ ID NO: 6244 - protein, 168 aa, Homo sapiens
  Payload ID: 1354;
  Gene Symbol: RNPEP;
  Gene Name: arginyl aminopeptidase (aminopeptidase B);
  ENSP ID: ENSP00000407614
LIDAAKEEYNGVIEEFLATGEKLFGPYVWGRYDLLFMPPSFPFGGMENPCLTFVTPCLLAGDRSLADVIIHEISHSWFGNLVTNANWGEFWLNEGFTMYAQRRISTILFGVDPDDTYNETPYEKGFCFVSYLAHLVGDQDQFDSFLKAYVHEFKFRSILADDFLDFYL

SEQ ID NO: 6245 - protein, 171 aa, Homo sapiens
  Payload ID: 1354;
  Gene Symbol: RNPEP;
  Gene Name: arginyl aminopeptidase (aminopeptidase B);
  ENSP ID: ENSP00000478325
FRAFELLHLHLDLRAEFGPPGPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEEPGVG

SEQ ID NO: 6246 - protein, 151 aa, Homo sapiens
  Payload ID: 1354;
  Gene Symbol: RNPEP;
  Gene Name: arginyl aminopeptidase (aminopeptidase B);
  ENSP ID: ENSP00000478884
  MOD_RES (1)..(1): Any amino acid
XPGAGSRGLSGTAVLDLRCLEPEGAAELRLDSHPCLEVTAAALRRERPGSEEPPAEPVSFYTQPFSHYGQALCVSFPQPCRAAERLQVLLTYRVGEGPGVCWLAPEQTAGKKKPFVYTQGQAVLNRAFFPCFDTPAVKYKYSALIEEPGVG

SEQ ID NO: 6247 - protein, 494 aa, Homo sapiens
  Payload ID: 1355;
  Gene Symbol: RNPEPL1;
  Gene Name: arginyl aminopeptidase (aminopeptidase B)-like 1;
  Uniprot ID:  Q9HAU8;
  ENSP ID: ENSP00000270357
MSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 6248 - protein, 247 aa, Homo sapiens
  Payload ID: 1355;
  Gene Symbol: RNPEPL1;
  Gene Name: arginyl aminopeptidase (aminopeptidase B)-like 1;
  ENSP ID: ENSP00000403319
AYVEKYKFTSVVAQDLLDSFLSFFPELKEQSVDCRAGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 6249 - protein, 114 aa, Homo sapiens
  Payload ID: 1355;
  Gene Symbol: RNPEPL1;
  Gene Name: arginyl aminopeptidase (aminopeptidase B)-like 1;
  ENSP ID: ENSP00000414661
MKLLGEDSPVSKLQAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTAL

SEQ ID NO: 6250 - protein, 518 aa, Homo sapiens
  Payload ID: 1356;
  Gene Symbol: ATE1;
  Gene Name: arginyltransferase 1;
  Uniprot ID:  O95260;
  ENSP ID: ENSP00000224652
MAFWAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 6251 - protein, 422 aa, Homo sapiens
  Payload ID: 1356;
  Gene Symbol: ATE1;
  Gene Name: arginyltransferase 1;
  ENSP ID: ENSP00000358036
MLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRLVPVSFEDPEFKSSFSQSFSLYVKYQVAIHQDPPDECGKTEFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 6252 - protein, 518 aa, Homo sapiens
  Payload ID: 1356;
  Gene Symbol: ATE1;
  Gene Name: arginyltransferase 1;
  Uniprot ID:  O95260;
  ENSP ID: ENSP00000358039
MAFWAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRLVPVSFEDPEFKSSFSQSFSLYVKYQVAIHQDPPDECGKTEFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 6253 - protein, 515 aa, Homo sapiens
  Payload ID: 1356;
  Gene Symbol: ATE1;
  Gene Name: arginyltransferase 1;
  ENSP ID: ENSP00000397787
  MOD_RES (1)..(1): Any amino acid
XAGGSPSVVDYFPSEDFYRCGYCKNESGSRSNGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 6254 - protein, 222 aa, Homo sapiens
  Payload ID: 1356;
  Gene Symbol: ATE1;
  Gene Name: arginyltransferase 1;
  ENSP ID: ENSP00000405099
MASVVEYKGLRAGYHCGYCDSKEGKASCGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGEL

SEQ ID NO: 6255 - protein, 511 aa, Homo sapiens
  Payload ID: 1356;
  Gene Symbol: ATE1;
  Gene Name: arginyltransferase 1;
  ENSP ID: ENSP00000440881
MASVVEYKGLRAGYHCGYCDSKEGKASCGMWAHSMTVQDYQDLIDRGWRRSGKYVYKPVMNQTCCPQYTIRCRPLQFQPSKSHKKVLKKMLKFLAKGEVPKGSCEDEPMDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRLVPVSFEDPEFKSSFSQSFSLYVKYQVAIHQDPPDECGKTEFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 6256 - protein, 403 aa, Homo sapiens
  Payload ID: 1356;
  Gene Symbol: ATE1;
  Gene Name: arginyltransferase 1;
  ENSP ID: ENSP00000444852
MDSTMDDAVAGDFALINKLDIQCDLKTLSDDIKESLESEGKNSKKEEPQELLQSQDFVGEKLGSGEPSHSVKVHTVPKPGKGADLSKPPCRKAKEIRKERKRLKLMQQNPAGELEGFQAQGHPPSLFPPKAKSNQPKSLEDLIFESLPENASHKLEVRVVRSSPPSSQFKATLLESYQVYKRYQMVIHKNPPDTPTESQFTRFLCSSPLEAETPPNGPDCGYGSFHQQYWLDGKIIAVGVIDILPNCVSSVYLYYDPDYSFLSLGVYSALREIAFTRQLHEKTSQLSYYYMGFYIHSCPKMKYKGQYRPSDLLCPETYVWVPIEQCLPSLENSKYCRFNQDPEAVDEDRSTEPDRLQVFHKRAIMPYGVYKKQQKDPSEEAAVLQYASLVGQKCSERMLLFRN

SEQ ID NO: 6257 - protein, 660 aa, Homo sapiens
  Payload ID: 1357;
  Gene Symbol: RARS;
  Gene Name: arginyl-tRNA synthetase;
  Uniprot ID:  P54136;
  ENSP ID: ENSP00000231572
MDVLVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAENITKHLPDNECIEKVEIAGPGFINVHLRKDFVSEQLTSLLVNGVQLPALGENKKVIVDFSSPNIAKEMHVGHLRSTIIGESISRLFEFAGYDVLRLNHVGDWGTQFGMLIAHLQDKFPDYLTVSPPIGDLQVFYKESKKRFDTEEEFKKRAYQCVVLLQGKNPDITKAWKLICDVSRQELNKIYDALDVSLIERGESFYQDRMNDIVKEFEDRGFVQVDDGRKIVFVPGCSIPLTIVKSDGGYTYDTSDLAAIKQRLFEEKADMIIYVVDNGQSVHFQTIFAAAQMIGWYDPKVTRVFHAGFGVVLGEDKKKFKTRSGETVRLMDLLGEGLKRSMDKLKEKERDKVLTAEELNAAQTSVAYGCIKYADLSHNRLNDYIFSFDKMLDDRGNTAAYLLYAFTRIRSIARLANIDEEMLQKAARETKILLDHEKEWKLGRCILRFPEILQKILDDLFLHTLCDYIYELATAFTEFYDSCYCVEKDRQTGKILKVNMWRMLLCEAVAAVMAKGFDILGIKPVQRM

SEQ ID NO: 6258 - protein, 58 aa, Homo sapiens
  Payload ID: 1357;
  Gene Symbol: RARS;
  Gene Name: arginyl-tRNA synthetase;
  ENSP ID: ENSP00000428494
MDVLVSECSARLLQQSLALSSRLECSGTISTHRNLSLWDSGNSPASASQVARITGRRD

SEQ ID NO: 6259 - protein, 129 aa, Homo sapiens
  Payload ID: 1357;
  Gene Symbol: RARS;
  Gene Name: arginyl-tRNA synthetase;
  ENSP ID: ENSP00000429030
MDVLVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQVLLMST

SEQ ID NO: 6260 - protein, 113 aa, Homo sapiens
  Payload ID: 1357;
  Gene Symbol: RARS;
  Gene Name: arginyl-tRNA synthetase;
  ENSP ID: ENSP00000430035
MDVLVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPNAQNQGTES

SEQ ID NO: 6261 - protein, 58 aa, Homo sapiens; identical to SEQ ID NO: 6258
  Payload ID: 1357;
  Gene Symbol: RARS;
  Gene Name: arginyl-tRNA synthetase;
  ENSP ID: ENSP00000486284

SEQ ID NO: 6262 - protein, 578 aa, Homo sapiens
  Payload ID: 1358;
  Gene Symbol: RARS2;
  Gene Name: arginyl-tRNA synthetase 2, mitochondrial;
  Uniprot ID:  Q5T160;
  ENSP ID: ENSP00000358549
MACGFRRAIACQLSRVLNLPPENLITSISAVPISQKEEVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQFGLLGTGFQLFGYEEKLQSNPLQHLFEVYVQVNKEAADDKSVAKAAQEFFQRLELGDVQALSLWQKFRDLSIEEYIRVYKRLGVYFDEYSGESFYREKSQEVLKLLESKGLLLKTIKGTAVVDLSGNGDPSSICTVMRSDGTSLYATRDLAAAIDRMDKYNFDTMIYVTDKGQKKHFQQVFQMLKIMGYDWAERCQHVPFGVVQGMKTRRGDVTFLEDVLNEIQLRMLQNMASIKTTKELKNPQETAERVGLAALIIQDFKGLLLSDYKFSWDRVFQSRGDTGVFLQYTHARLHSLEETFGCGYLNDFNTACLQEPQSVSILQHLLRFDEVLYKSSQDFQPRHIVSYLLTLSHLAAVAHKTLQIKDSPPEVAGARLHLFKAVRSVLANGMKLLGITPVCRM

SEQ ID NO: 6263 - protein, 206 aa, Homo sapiens
  Payload ID: 1358;
  Gene Symbol: RARS2;
  Gene Name: arginyl-tRNA synthetase 2, mitochondrial;
  ENSP ID: ENSP00000389656
  MOD_RES (1)..(1): Any amino acid
XFQSVESSTRKLDHINICSSNFPKRSFALVTQAGVQWHNLDSLQSPPPGFKRFPCLSLPSSWDCREVADFQLSVDSLLEKDNDHSRPDIQVQAKRLAEKLRCDTVVSEISTGQRTVNFKINRELLTKTVLQQVIEDGSKYGLKSELFSGLPQKKIVVEFSSPNVAKKFHVGHLRSTIIGNFIANLKEALGHQVIRINYLGDWGMQF

SEQ ID NO: 6264 - protein, 857 aa, Homo sapiens
  Payload ID: 1359;
  Gene Symbol: AGO1;
  Gene Name: argonaute RISC catalytic component 1;
  Uniprot ID:  Q9UL18;
  ENSP ID: ENSP00000362300
MEAGPSGAAAGAYLPPLQQVFQAPRRPGIGTVGKPIKLLANYFEVDIPKIDVYHYEVDIKPDKCPRRVNREVVEYMVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQGTSRPSHYYVLWDDNRFTADELQILTYQLCHTYVRCTRSVSIPAPAYYARLVAFRARYHLVDKEHDSGEGSHISGQSNGRDPQALAKAVQVHQDTLRTMYFA

SEQ ID NO: 6265 - protein, 782 aa, Homo sapiens
  Payload ID: 1359;
  Gene Symbol: AGO1;
  Gene Name: argonaute RISC catalytic component 1;
  ENSP ID: ENSP00000362302
MVQHFKPQIFGDRKPVYDGKKNIYTVTALPIGNERVDFEVTIPGEGKDRIFKVSIKWLAIVSWRMLHEALVSGQIPVPLESVQALDVAMRHLASMRYTPVGRSFFSPPEGYYHPLGGGREVWFGFHQSVRPAMWKMMLNIDVSATAFYKAQPVIEFMCEVLDIRNIDEQPKPLTDSQRVRFTKEIKGLKVEVTHCGQMKRKYRVCNVTRRPASHQTFPLQLESGQTVECTVAQYFKQKYNLQLKYPHLPCLQVGQEQKHTYLPLEVCNIVAGQRCIKKLTDNQTSTMIKATARSAPDRQEEISRLMKNASYNLDPYIQEFGIKVKDDMTEVTGRVLPAPILQYGGRNRAIATPNQGVWDMRGKQFYNGIEIKVWAIACFAPQKQCREEVLKNFTDQLRKISKDAGMPIQGQPCFCKYAQGADSVEPMFRHLKNTYSGLQLIIVILPGKTPVYAEVKRVGDTLLGMATQCVQVKNVVKTSPQTLSNLCLKINVKLGGINNILVPHQRSAVFQQPVIFLGADVTHPPAGDGKKPSITAVVGSMDAHPSRYCATVRVQRPRQEIIEDLSYMVRELLIQFYKSTRFKPTRIIFYRDGVPEGQLPQILHYELLAIRDACIKLEKDYQPGITYIVVQKRHHTRLFCADKNERIGKSGNIPAGTTVDTNITHPFEFDFYLCSHAGIQGTSRPSHYYVLWDDNRFTADELQILTYQLCHTYVRCTRSVSIPAPAYYARLVAFRARYHLVDKEHDSGEGSHISGQSNGRDPQALAKAVQVHQDTLRTMYFA

SEQ ID NO: 6266 - protein, 133 aa, Homo sapiens
  Payload ID: 1359;
  Gene Symbol: AGO1;
  Gene Name: argonaute RISC catalytic component 1;
  ENSP ID: ENSP00000489254
  MOD_RES (1)..(1): Any amino acid
XHFKPQIFGDRKPVYDGKKNIYTVTALPIGNERVDFEVTIPGEGKDRIFKVSIKWLAIVSWRMLHEALVSGQIPVPLESVQALDVAMRHLASMRPGLLRAQDASQGGGLCPRDQFSACPCQVHPCGPLLLLTA

SEQ ID NO: 6267 - protein, 859 aa, Homo sapiens
  Payload ID: 1360;
  Gene Symbol: AGO2;
  Gene Name: argonaute RISC catalytic component 2;
  Uniprot ID:  Q9UKV8;
  ENSP ID: ENSP00000220592
MYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 6268 - protein, 73 aa, Homo sapiens
  Payload ID: 1360;
  Gene Symbol: AGO2;
  Gene Name: argonaute RISC catalytic component 2;
  ENSP ID: ENSP00000430164
MYSGAGPGKSWNTWSSTLKHRSLGIGSPCLTAGRIYTQPCPFRLGGTRWSWRSRCQEKARIASSRCPSSGCPA

SEQ ID NO: 6269 - protein, 825 aa, Homo sapiens
  Payload ID: 1360;
  Gene Symbol: AGO2;
  Gene Name: argonaute RISC catalytic component 2;
  Uniprot ID:  Q9UKV8;
  ENSP ID: ENSP00000430176
MYSGAGPALAPPAPPPPIQGYAFKPPPRPDFGTSGRTIKLQANFFEMDIPKIDIYHYELDIKPEKCPRRVNREIVEHMVQHFKTQIFGDRKPVFDGRKNLYTAMPLPIGRDKVELEVTLPGEGKDRIFKVSIKWVSCVSLQALHDALSGRLPSVPFETIQALDVVMRHLPSMRYTPVGRSFFTASEGCSNPLGGGREVWFGFHQSVRPSLWKMMLNIDVSATAFYKAQPVIEFVCEVLDFKSIEEQQKPLTDSQRVKFTKEIKGLKVEITHCGQMKRKYRVCNVTRRPASHQTFPLQQESGQTVECTVAQYFKDRHKLVLRYPHLPCLQVGQEQKHTYLPLEVCNIVAGQRCIKKLTDNQTSTMIRATARSAPDRQEEISKLMRSASFNTDPYVREFGIMVKDEMTDVTGRVLQPPSILYGGRNKAIATPVQGVWDMRNKQFHTGIEIKVWAIACFAPQRQCTEVHLKSFTEQLRKISRDAGMPIQGQPCFCKYAQGADSVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 6270 - protein, 36 aa, Homo sapiens
  Payload ID: 1360;
  Gene Symbol: AGO2;
  Gene Name: argonaute RISC catalytic component 2;
  ENSP ID: ENSP00000431056
MDIPKIDIYHYELDIKPEKCPRRVNREIVEHMVQHF

SEQ ID NO: 6271 - protein, 626 aa, Homo sapiens
  Payload ID: 1361;
  Gene Symbol: AGO3;
  Gene Name: argonaute RISC catalytic component 3;
  Uniprot ID:  Q9H9G7;
  ENSP ID: ENSP00000246314
MCEVLDIHNIDEQPRPLTDSHRVKFTKEIKGLKVEVTHCGTMRRKYRVCNVTRRPASHQTFPLQLENGQTVERTVAQYFREKYTLQLKYPHLPCLQVGQEQKHTYLPLEVCNIVAGQRCIKKLTDNQTSTMIKATARSAPDRQEEISRLVRSANYETDPFVQEFQFKVRDEMAHVTGRVLPAPMLQYGGRNRTVATPSHGVWDMRGKQFHTGVEIKMWAIACFATQRQCREEILKGFTDQLRKISKDAGMPIQGQPCFCKYAQGADSVEPMFRHLKNTYSGLQLIIVILPGKTPVYAEVKRVGDTLLGMATQCVQVKNVIKTSPQTLSNLCLKINVKLGGINNILVPHQRPSVFQQPVIFLGADVTHPPAGDGKKPSIAAVVGSMDAHPSRYCATVRVQRPRQEIIQDLASMVRELLIQFYKSTRFKPTRIIFYRDGVSEGQFRQVLYYELLAIREACISLEKDYQPGITYIVVQKRHHTRLFCADRTERVGRSGNIPAGTTVDTDITHPYEFDFYLCSHAGIQGTSRPSHYHVLWDDNCFTADELQLLTYQLCHTYVRCTRSVSIPAPAYYAHLVAFRARYHLVDKEHDSAEGSHVSGQSNGRDPQALAKAVQIHQDTLRTMYFA

SEQ ID NO: 6272 - protein, 229 aa, Homo sapiens
  Payload ID: 1361;
  Gene Symbol: AGO3;
  Gene Name: argonaute RISC catalytic component 3;
  ENSP ID: ENSP00000317425
MEIGSAGPAGAQPLLMVPRRPGYGTMGKPIKLLANCFQVEIPKIDVYLYEVDIKPDKCPRRVNREVVDSMVQHFKVTIFGDRRPVYDGKRSLYTANPLPVATTGVDLDVTLPGEGGKDRPFKVSIKFVSRVSWHLLHEVLTGRTLPEPLELDKPISTNPVHAVDVVLRHLPSMKYTPVGRSFFSAPEGYDHPLGGGREVWFGFHQSVRPAMWKMMLNIDERDLWQQCGE

SEQ ID NO: 6273 - protein, 860 aa, Homo sapiens
  Payload ID: 1361;
  Gene Symbol: AGO3;
  Gene Name: argonaute RISC catalytic component 3;
  Uniprot ID:  Q9H9G7;
  ENSP ID: ENSP00000362287
MEIGSAGPAGAQPLLMVPRRPGYGTMGKPIKLLANCFQVEIPKIDVYLYEVDIKPDKCPRRVNREVVDSMVQHFKVTIFGDRRPVYDGKRSLYTANPLPVATTGVDLDVTLPGEGGKDRPFKVSIKFVSRVSWHLLHEVLTGRTLPEPLELDKPISTNPVHAVDVVLRHLPSMKYTPVGRSFFSAPEGYDHPLGGGREVWFGFHQSVRPAMWKMMLNIDVSATAFYKAQPVIQFMCEVLDIHNIDEQPRPLTDSHRVKFTKEIKGLKVEVTHCGTMRRKYRVCNVTRRPASHQTFPLQLENGQTVERTVAQYFREKYTLQLKYPHLPCLQVGQEQKHTYLPLEVCNIVAGQRCIKKLTDNQTSTMIKATARSAPDRQEEISRLVRSANYETDPFVQEFQFKVRDEMAHVTGRVLPAPMLQYGGRNRTVATPSHGVWDMRGKQFHTGVEIKMWAIACFATQRQCREEILKGFTDQLRKISKDAGMPIQGQPCFCKYAQGADSVEPMFRHLKNTYSGLQLIIVILPGKTPVYAEVKRVGDTLLGMATQCVQVKNVIKTSPQTLSNLCLKINVKLGGINNILVPHQRPSVFQQPVIFLGADVTHPPAGDGKKPSIAAVVGSMDAHPSRYCATVRVQRPRQEIIQDLASMVRELLIQFYKSTRFKPTRIIFYRDGVSEGQFRQVLYYELLAIREACISLEKDYQPGITYIVVQKRHHTRLFCADRTERVGRSGNIPAGTTVDTDITHPYEFDFYLCSHAGIQGTSRPSHYHVLWDDNCFTADELQLLTYQLCHTYVRCTRSVSIPAPAYYAHLVAFRARYHLVDKEHDSAEGSHVSGQSNGRDPQALAKAVQIHQDTLRTMYFA

SEQ ID NO: 6274 - protein, 229 aa, Homo sapiens; identical to SEQ ID NO: 6272
  Payload ID: 1361;
  Gene Symbol: AGO3;
  Gene Name: argonaute RISC catalytic component 3;
  ENSP ID: ENSP00000380928

SEQ ID NO: 6275 - protein, 64 aa, Homo sapiens
  Payload ID: 1361;
  Gene Symbol: AGO3;
  Gene Name: argonaute RISC catalytic component 3;
  ENSP ID: ENSP00000489286
MEIGSAGPAGAQPLLMVPRRPGYGTMGKPIKLLANCFQVEIPKIDVYLYEVDIKPDKCPRRVNR

SEQ ID NO: 6276 - protein, 861 aa, Homo sapiens
  Payload ID: 1362;
  Gene Symbol: AGO4;
  Gene Name: argonaute RISC catalytic component 4;
  Uniprot ID:  Q9HCK5;
  ENSP ID: ENSP00000362306
MEALGPGPPASLFQPPRRPGLGTVGKPIRLLANHFQVQIPKIDVYHYDVDIKPEKRPRRVNREVVDTMVRHFKMQIFGDRQPGYDGKRNMYTAHPLPIGRDRVDMEVTLPGEGKDQTFKVSVQWVSVVSLQLLLEALAGHLNEVPDDSVQALDVITRHLPSMRYTPVGRSFFSPPEGYYHPLGGGREVWFGFHQSVRPAMWNMMLNIDVSATAFYRAQPIIEFMCEVLDIQNINEQTKPLTDSQRVKFTKEIRGLKVEVTHCGQMKRKYRVCNVTRRPASHQTFPLQLENGQAMECTVAQYFKQKYSLQLKYPHLPCLQVGQEQKHTYLPLEVCNIVAGQRCIKKLTDNQTSTMIKATARSAPDRQEEISRLVKSNSMVGGPDPYLKEFGIVVHNEMTELTGRVLPAPMLQYGGRNKTVATPNQGVWDMRGKQFYAGIEIKVWAVACFAPQKQCREDLLKSFTDQLRKISKDAGMPIQGQPCFCKYAQGADSVEPMFKHLKMTYVGLQLIVVILPGKTPVYAEVKRVGDTLLGMATQCVQVKNVVKTSPQTLSNLCLKINAKLGGINNVLVPHQRPSVFQQPVIFLGADVTHPPAGDGKKPSIAAVVGSMDGHPSRYCATVRVQTSRQEISQELLYSQEVIQDLTNMVRELLIQFYKSTRFKPTRIIYYRGGVSEGQMKQVAWPELIAIRKACISLEEDYRPGITYIVVQKRHHTRLFCADKTERVGKSGNVPAGTTVDSTITHPSEFDFYLCSHAGIQGTSRPSHYQVLWDDNCFTADELQLLTYQLCHTYVRCTRSVSIPAPAYYARLVAFRARYHLVDKDHDSAEGSHVSGQSNGRDPQALAKAVQIHHDTQHTMYFA

SEQ ID NO: 6277 - protein, 517 aa, Homo sapiens
  Payload ID: 1363;
  Gene Symbol: ARHGAP19-SLIT1;
  Gene Name: ARHGAP19-SLIT1 readthrough (NMD candidate);
  ENSP ID: ENSP00000473567
MATEAQSEGEVPARESGRSDAICSFVICNDSSLRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLHKNLRVEGLFRVPGNSVRQQILRDALNNGTDIDLESGEFHSNDVATLLKMFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGNSMATTSLGSIRMTLRGSSSCGCCS

SEQ ID NO: 6278 - protein, 290 aa, Homo sapiens
  Payload ID: 1364;
  Gene Symbol: ARIH2OS;
  Gene Name: ariadne homolog 2 opposite strand;
  Uniprot ID:  Q8N7S6;
  ENSP ID: ENSP00000386193
MLGQRAGDGERPGLPGDGEGGVPARPGRRAERPPQRPAKVNKAVTCAAHLPGAAASRPLSPNKPDRVRPGQRDRIGAKRQRRRRADAGQARAASSRRVVPTAPEVLGAVASLPDRGRPTVARVATGSRLEGLFSAASLKLSALTQSLTRVRQAPTASGATIRLPASPVEMFLTSAFLTGFSFHCLYSGIGHGEDILASVEQITIVSRPLSGQRGAGPGNSAYTPRRSQGGPRAATTPGFRFPCRGLVRRAVLRLTVTVQDCILTALLAVSFHSIGVVIMTSSYLLGPVVK

SEQ ID NO: 6279 - protein, 557 aa, Homo sapiens
  Payload ID: 1365;
  Gene Symbol: ARIH1;
  Gene Name: ariadne RBR E3 ubiquitin prt ligase 1;
  Uniprot ID:  Q9Y4X5;
  ENSP ID: ENSP00000369217
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 6280 - protein, 204 aa, Homo sapiens
  Payload ID: 1365;
  Gene Symbol: ARIH1;
  Gene Name: ariadne RBR E3 ubiquitin prt ligase 1;
  ENSP ID: ENSP00000454774
  MOD_RES (1)..(1): Any amino acid
XSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERRLITDSKVKLKYQHLITNSFVECNRLLKWCPAPDCHHVVKVQYPDAKPVRCKCGRQF

SEQ ID NO: 6281 - protein, 167 aa, Homo sapiens
  Payload ID: 1365;
  Gene Symbol: ARIH1;
  Gene Name: ariadne RBR E3 ubiquitin prt ligase 1;
  ENSP ID: ENSP00000456746
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMESISLALNVDISFVCSAGVNI

SEQ ID NO: 6282 - protein, 47 aa, Homo sapiens
  Payload ID: 1365;
  Gene Symbol: ARIH1;
  Gene Name: ariadne RBR E3 ubiquitin prt ligase 1;
  ENSP ID: ENSP00000457767
  MOD_RES (1)..(1): Any amino acid
XNEDDAKAARDAQECLALSPRLEYSGMISAHCNLHLLGSSDSPASAS

SEQ ID NO: 6283 - protein, 114 aa, Homo sapiens
  Payload ID: 1365;
  Gene Symbol: ARIH1;
  Gene Name: ariadne RBR E3 ubiquitin prt ligase 1;
  ENSP ID: ENSP00000477687
RSRAALQRYLFYCNRYMNHMQSLRFEHKLYAQVKQKMEEMQQHNMSWIENNQADLENATEVLSGYLERDISQDSLQDIKQKVQDKYRYCESRRRVLLQHVHEGYEKDLWEYIED

SEQ ID NO: 6284 - protein, 493 aa, Homo sapiens
  Payload ID: 1366;
  Gene Symbol: ARIH2;
  Gene Name: ariadne RBR E3 ubiquitin prt ligase 2;
  Uniprot ID:  O95376;
  ENSP ID: ENSP00000348769
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHHCAVCMQFVRKENLLSLACQHQFCRSCWEQHCSVLVKDGVGVGVSCMAQDCPLRTPEDFVFPLLPNEELREKYRRYLFRDYVESHYQLQLCPGADCPMVIRVQEPRARRVQCNRCNEVFCFKCRQMYHAPTDCATIRKWLTKCADDSETANYISAHTKDCPKCNICIEKNGGCNHMQCSKCKHDFCWMCLGDWKTHGSEYYECSRYKENPDIVNQSQQAQAREALKKYLFYFERWENHNKSLQLEAQTYQRIHEKIQERVMNNLGTWIDWQYLQNAAKLLAKCRYTLQYTYPYAYYMESGPRKKLFEYQQAQLEAEIENLSWKVERADSYDRGDLENQMHIAEQRRRTLLKDFHDT

SEQ ID NO: 6285 - protein, 107 aa, Homo sapiens
  Payload ID: 1366;
  Gene Symbol: ARIH2;
  Gene Name: ariadne RBR E3 ubiquitin prt ligase 2;
  ENSP ID: ENSP00000395560
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILD

SEQ ID NO: 6286 - protein, 107 aa, Homo sapiens; identical to SEQ ID NO: 6285
  Payload ID: 1366;
  Gene Symbol: ARIH2;
  Gene Name: ariadne RBR E3 ubiquitin prt ligase 2;
  ENSP ID: ENSP00000397225

SEQ ID NO: 6287 - protein, 138 aa, Homo sapiens
  Payload ID: 1366;
  Gene Symbol: ARIH2;
  Gene Name: ariadne RBR E3 ubiquitin prt ligase 2;
  ENSP ID: ENSP00000399788
MSVDMNSQGSDSNEEDYDPNCEEEEEEEEDDPGDIEDYYVGVASDVEQQGADAFDPEEYQFTCLTYKESEGALNEHMTSLASVLKVSHSVAKLILVNFHWQVSEILDRYKSNSAQLLVEARVQPNPSKHVPTSHPPHH

SEQ ID NO: 6288 - protein, 493 aa, Homo sapiens; identical to SEQ ID NO: 6284
  Payload ID: 1366;
  Gene Symbol: ARIH2;
  Gene Name: ariadne RBR E3 ubiquitin prt ligase 2;
  Uniprot ID:  O95376;
  ENSP ID: ENSP00000403222

SEQ ID NO: 6289 - protein, 106 aa, Homo sapiens
  Payload ID: 1366;
  Gene Symbol: ARIH2;
  Gene Name: ariadne RBR E3 ubiquitin prt ligase 2;
  ENSP ID: ENSP00000403845
MSVDMNSQGSDSNEEDYDPNCEEEEEEEEDDPGDIEDYYVGVASDVEQQGADAFDPEEYQFTCLTYKESEGALNEHMTSLASVLKAVDAHCHQLHPPYGTGISFSC

SEQ ID NO: 6290 - protein, 85 aa, Homo sapiens
  Payload ID: 1366;
  Gene Symbol: ARIH2;
  Gene Name: ariadne RBR E3 ubiquitin prt ligase 2;
  ENSP ID: ENSP00000404838
MSVDMNSQGSDSNEEDYDPNCEEEEEEEEDDPGDIEDYYVGVASDVEQQGADAFDPEEYQFTCLTYKESEGALNEHMTSLASVLK

SEQ ID NO: 6291 - protein, 55 aa, Homo sapiens
  Payload ID: 1366;
  Gene Symbol: ARIH2;
  Gene Name: ariadne RBR E3 ubiquitin prt ligase 2;
  ENSP ID: ENSP00000406063
MSVDMNSQGSDSNEEDYDPNCEEEEEEEEDDPGDIEDYYVGVASDVEQQGADAFD

SEQ ID NO: 6292 - protein, 562 aa, Homo sapiens
  Payload ID: 1367;
  Gene Symbol: ARX;
  Gene Name: aristaless related homeobox;
  Uniprot ID:  Q96QS3;
  ENSP ID: ENSP00000368332
MSNQYQEEGCSERPECKSKSPTLLSSYCIDSILGRRSPCKMRLLGAAQSLPAPLTSRADPEKAVQGSPKSSSAPFEAELHLPPKLRRLYGPGGGRLLQGAAAAAAAAAAAAAAAATATAGPRGEAPPPPPPTARPGERPDGAGAAAAAAAAAAAAWDTLKISQAPQVSISRSKSYRENGAPFVPPPPALDELGGPGGVTHPEERLGVAGGPGSAPAAGGGTGTEDDEEELLEDEEDEDEEEELLEDDEEELLEDDARALLKEPRRCPVAATGAVAAAAAAAVATEGGELSPKEELLLHPEDAEGKDGEDSVCLSAGSDSEEGLLKRKQRRYRTTFTSYQLEELERAFQKTHYPDVFTREELAMRLDLTEARVQVWFQNRRAKWRKREKAGAQTHPPGLPFPGPLSATHPLSPYLDASPFPPHHPALDSAWTAAAAAAAAAFPSLPPPPGSASLPPSGAPLGLSTFLGAAVFRHPAFISPAFGRLFSTMAPLTSASTAAALLRQPTPAVEGAVASGALADPATAAADRRASSIAALRLKAKEHAAQLTQLNILPGTSTGKEVC

SEQ ID NO: 6293 - protein, 113 aa, Homo sapiens
  Payload ID: 1368;
  Gene Symbol: ARL2-SNX15;
  Gene Name: ARL2-SNX15 readthrough (NMD candidate);
  ENSP ID: ENSP00000476630
MGLLTILKKMKQKERELRLLMLGLDNAGKTTILKKFNGEDIDTISPTLGFNIKTLEHRGFKLNIWDVGGQKSLRSYWRNYFESTDGLIWVVDSADRQRMQDCQRELQSLLVEE

SEQ ID NO: 6294 - protein, 282 aa, Homo sapiens
  Payload ID: 1369;
  Gene Symbol: ARMC1;
  Gene Name: armadillo repeat containing 1;
  Uniprot ID:  Q9NVT9;
  ENSP ID: ENSP00000276569
MNSSTSTMSEEPDALSVVNQLRDLAADPLNRRAIVQDQGCLPGLILFMDHPNPPVVHSALLALRYLAECRANREKMKGELGMMLSLQNVIQKTTTPGETKLLASEIYDILQSSNMADGDSFNEMNSRRRKAQFFLGTTNKRAKTVVLHIDGLDDTSRRNLCEEALLKIKGVISFTFQMAVQRCVVRIRSDLKAEALASAIASTKVMKAQQVVKSESGEEMLVPFQDTPVEVEQNTELPDYLPEDESPTKEQDKAVSRVGSHPEGGASWLSTAANFLSRSFYW

SEQ ID NO: 6295 - protein, 180 aa, Homo sapiens
  Payload ID: 1369;
  Gene Symbol: ARMC1;
  Gene Name: armadillo repeat containing 1;
  Uniprot ID:  Q9NVT9;
  ENSP ID: ENSP00000388572
MSAWPYFIYGPSQPSSRPLRFACSSILGRMPCKQRKDERRTGYDVELTKCYTESRRNLCEEALLKIKGVISFTFQMAVQRCVVRIRSDLKAEALASAIASTKVMKAQQVVKSESGEEMLVPFQDTPVEVEQNTELPDYLPEDESPTKEQDKAVSRVGSHPEGGASWLSTAANFLSRSFYW

SEQ ID NO: 6296 - protein, 190 aa, Homo sapiens
  Payload ID: 1369;
  Gene Symbol: ARMC1;
  Gene Name: armadillo repeat containing 1;
  ENSP ID: ENSP00000429191
MNSSTSTMSEEPDALSVVNQLRDLAADPLNRRAIVQDQGCLPGLILFMDHPNPPVVHSALLALRYLAECRANREKMKGELGMMLSLQNVIQKTTTPGETKLLASEIYDILQSSNMADGDSFNEMNSRRRKAQFFLGTTNKRAKTVVLHIDGLDDTSRRNLCEEALLKIKGVISFTFQMAVQRCVVRIRSD

SEQ ID NO: 6297 - protein, 123 aa, Homo sapiens
  Payload ID: 1369;
  Gene Symbol: ARMC1;
  Gene Name: armadillo repeat containing 1;
  ENSP ID: ENSP00000429715
MNSSTSTMSEEPDALSVVNQLRDLAADPLNRRAIVQDQGCLPGLILFMDHPNPPVVHSALLALRYLAECRANREKMKGELGMMLSLQNVIQKTTTPGETKLLASEIYDILQSSNMADGDSFNE

SEQ ID NO: 6298 - protein, 102 aa, Homo sapiens
  Payload ID: 1369;
  Gene Symbol: ARMC1;
  Gene Name: armadillo repeat containing 1;
  ENSP ID: ENSP00000434297
MNSSTSTMSEEPDALSVVNQLRDLAADPLNRRAIVQDQGCLPGLILFMDHPNPPVVHSALLALRYLAECRANREKMKGELGMMLSLQNVIQNLGEIYVKRLC

SEQ ID NO: 6299 - protein, 81 aa, Homo sapiens
  Payload ID: 1370;
  Gene Symbol: ARMC10;
  Gene Name: armadillo repeat containing 10;
  ENSP ID: ENSP00000305395
MGGPRGAGWVAAGLLLGAGACYCIYRLTRGRRRGDRELGIRSSKSADEKTETPKNSKCSLDGCTSFLKGEAKCYQHLRRLN

SEQ ID NO: 6300 - protein, 343 aa, Homo sapiens
  Payload ID: 1370;
  Gene Symbol: ARMC10;
  Gene Name: armadillo repeat containing 10;
  Uniprot ID:  Q8N2F6;
  ENSP ID: ENSP00000319412
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6301 - protein, 193 aa, Homo sapiens
  Payload ID: 1370;
  Gene Symbol: ARMC10;
  Gene Name: armadillo repeat containing 10;
  ENSP ID: ENSP00000319798
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKPRITFRGMENKTEEGGT

SEQ ID NO: 6302 - protein, 284 aa, Homo sapiens
  Payload ID: 1370;
  Gene Symbol: ARMC10;
  Gene Name: armadillo repeat containing 10;
  Uniprot ID:  Q8N2F6;
  ENSP ID: ENSP00000396654
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6303 - protein, 284 aa, Homo sapiens
  Payload ID: 1370;
  Gene Symbol: ARMC10;
  Gene Name: armadillo repeat containing 10;
  Uniprot ID:  Q8N2F6;
  ENSP ID: ENSP00000397969
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6304 - protein, 233 aa, Homo sapiens
  Payload ID: 1370;
  Gene Symbol: ARMC10;
  Gene Name: armadillo repeat containing 10;
  ENSP ID: ENSP00000398201
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQIPMKLVTGITFAIIRELGGIPIVANKINHSNQSIKEKALNALNNLSVNVENQIKIKVDSSFLSLYDSHVAKEILLRVLTLFQNIKNCLKIEGHLAVQPTFTE

SEQ ID NO: 6305 - protein, 249 aa, Homo sapiens
  Payload ID: 1370;
  Gene Symbol: ARMC10;
  Gene Name: armadillo repeat containing 10;
  Uniprot ID:  Q8N2F6;
  ENSP ID: ENSP00000405612
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6306 - protein, 185 aa, Homo sapiens
  Payload ID: 1370;
  Gene Symbol: ARMC10;
  Gene Name: armadillo repeat containing 10;
  ENSP ID: ENSP00000406840
RELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6307 - protein, 308 aa, Homo sapiens
  Payload ID: 1370;
  Gene Symbol: ARMC10;
  Gene Name: armadillo repeat containing 10;
  Uniprot ID:  Q8N2F6;
  ENSP ID: ENSP00000413619
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6308 - protein, 225 aa, Homo sapiens
  Payload ID: 1370;
  Gene Symbol: ARMC10;
  Gene Name: armadillo repeat containing 10;
  Uniprot ID:  Q8N2F6;
  ENSP ID: ENSP00000440463
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6309 - protein, 153 aa, Homo sapiens
  Payload ID: 1370;
  Gene Symbol: ARMC10;
  Gene Name: armadillo repeat containing 10;
  ENSP ID: ENSP00000487721
AIIRELGGIPIVANKINHSNQSIKEKALNALNNLSVNVENQIKIKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6310 - protein, 185 aa, Homo sapiens; identical to SEQ ID NO: 6306
  Payload ID: 1370;
  Gene Symbol: ARMC10;
  Gene Name: armadillo repeat containing 10;
  ENSP ID: ENSP00000487771

SEQ ID NO: 6311 - protein, 153 aa, Homo sapiens; identical to SEQ ID NO: 6309
  Payload ID: 1370;
  Gene Symbol: ARMC10;
  Gene Name: armadillo repeat containing 10;
  ENSP ID: ENSP00000488082

SEQ ID NO: 6312 - protein, 212 aa, Homo sapiens
  Payload ID: 1370;
  Gene Symbol: ARMC10;
  Gene Name: armadillo repeat containing 10;
  ENSP ID: ENSP00000488365
AIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 6313 - protein, 212 aa, Homo sapiens; identical to SEQ ID NO: 6312
  Payload ID: 1370;
  Gene Symbol: ARMC10;
  Gene Name: armadillo repeat containing 10;
  ENSP ID: ENSP00000488536

SEQ ID NO: 6314 - protein, 91 aa, Homo sapiens
  Payload ID: 1370;
  Gene Symbol: ARMC10;
  Gene Name: armadillo repeat containing 10;
  ENSP ID: ENSP00000488561
AIIRELGGIPIVANKINHSNQSIKEKALNALNNLSVNVENQIKIKVDSSFLSLYDSHVAKEILLRVLTLFQNIKNCLKIEGHLAVQPTFTE

SEQ ID NO: 6315 - protein, 62 aa, Homo sapiens
  Payload ID: 1370;
  Gene Symbol: ARMC10;
  Gene Name: armadillo repeat containing 10;
  ENSP ID: ENSP00000488674
AIIRELGGIPIVANKINHSNQSIKEKALNALNNLSVNVENQIKIKPRITFRGMENKTEEGGT

SEQ ID NO: 6316 - protein, 367 aa, Homo sapiens
  Payload ID: 1371;
  Gene Symbol: ARMC12;
  Gene Name: armadillo repeat containing 12;
  Uniprot ID:  Q5T9G4;
  ENSP ID: ENSP00000288065
MGKSIPQYLGQLDIRKSVVSLATGAGAIYLLYKAIKAGIKCKPPLCSNSPICIARECPGPGERALPQEAPAPEASAVGGPKGLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQVHSNFLNLFQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 6317 - protein, 340 aa, Homo sapiens
  Payload ID: 1371;
  Gene Symbol: ARMC12;
  Gene Name: armadillo repeat containing 12;
  Uniprot ID:  Q5T9G4;
  ENSP ID: ENSP00000362973
MGKSIPQYLGQLDIRKSVVSLATGAGAIYLLYKAIKAGIKCKPPLCSNSPICIARLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQVHSNFLNLFQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 6318 - protein, 330 aa, Homo sapiens
  Payload ID: 1371;
  Gene Symbol: ARMC12;
  Gene Name: armadillo repeat containing 12;
  Uniprot ID:  Q5T9G4;
  ENSP ID: ENSP00000362976
MGKSIPQYLGQLDIRKSVVSLATGAGAIYLLYKAIKAGIKCKPPLCSNSPICIARLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 6319 - protein, 55 aa, Homo sapiens
  Payload ID: 1371;
  Gene Symbol: ARMC12;
  Gene Name: armadillo repeat containing 12;
  ENSP ID: ENSP00000418825
MGKSIPQYLGQLDIRKSVVSLATGAGAIYLLYKAIKAGIKCKPPLCSNSPICIAP

SEQ ID NO: 6320 - protein, 222 aa, Homo sapiens
  Payload ID: 1372;
  Gene Symbol: ARMC2;
  Gene Name: armadillo repeat containing 2;
  ENSP ID: ENSP00000237512
MLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKN

SEQ ID NO: 6321 - protein, 702 aa, Homo sapiens
  Payload ID: 1372;
  Gene Symbol: ARMC2;
  Gene Name: armadillo repeat containing 2;
  Uniprot ID:  Q8NEN0;
  ENSP ID: ENSP00000357968
MMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 6322 - protein, 867 aa, Homo sapiens
  Payload ID: 1372;
  Gene Symbol: ARMC2;
  Gene Name: armadillo repeat containing 2;
  Uniprot ID:  Q8NEN0;
  ENSP ID: ENSP00000376417
MLSPNDKMLGKLDPFYQPSVSKQKTSAEIISEARNALRTVRTQRPFTPQEAQRKLFGPASSRTSENRPPSSFSLHASSFESSDSRPISGTRLSPLELKPKVPASPTREEDSCFSFPKPPVDPAKIRRVSNARARLFRAASQRALLPDRSLPPSDSKKTVESKETVMMGDSMVKINGIYLTKSNAICHLKSHPLQLTDDGGFSEIKEQEMFKGTTSLPSHLKNGGDQGKRHARASSCPSSSDLSRLQTKAVPKADLQEEDAEIEVDEVFWNTRIVPILRELEKEENIETVCAACTQLHHALEEGNMLGNKFKGRSILLKTLCKLVDVGSDSLSLKLAKIILALKVSRKNLLNVCKLIFKISRNEKNDSLIQNDSILESLLEVLRSEDLQTNMEAFLYCMGSIKFISGNLGFLNEMISKGAVEILINLIKQINENIKKCGTFLPNSGHLLVQVTATLRNLVDSSLVRSKFLNISALPQLCTAMEQYKGDKDVCTNIARIFSKLTSYRDCCTALASYSRCYALFLNLINKYQKKQDLVVRVVFILGNLTAKNNQAREQFSKEKGSIQTLLSLFQTFHQLDLHSQKPVGQRGEQHRAQRPPSEAEDVLIKLTRVLANIAIHPGVGPVLAANPGIVGLLLTTLEYKSLDDCEELVINATATINNLSYYQVKNSIIQDKKLYIAELLLKLLVSNNMDGILEAVRVFGNLSQDHDVCDFIVQNNVHRFMMALLDAQHQDICFSACGVLLNLTVDKDKRVILKEGGGIKKLVDCLRDLGPTDWQLACLVCKTLWNFSENITNASSCFGNEDTNTLLLLLSSFLDEELALDGSFDPDLKNYHKLHWETEFKPVAQQLLNRIQRHHTFLEPLPIPSF

SEQ ID NO: 6323 - protein, 85 aa, Homo sapiens
  Payload ID: 1372;
  Gene Symbol: ARMC2;
  Gene Name: armadillo repeat containing 2;
  ENSP ID: ENSP00000393191
  MOD_RES (1)..(1): Any amino acid
XLPPSDSKKTVESKETVMMGDSMVKINGIYLTKSNAICHLKSHPLQLTDDGGFSEIKEQEMFKGTTSLPSHLKNGGPHCRLWNDD

SEQ ID NO: 6324 - protein, 872 aa, Homo sapiens
  Payload ID: 1373;
  Gene Symbol: ARMC3;
  Gene Name: armadillo repeat containing 3;
  Uniprot ID:  Q5W041;
  ENSP ID: ENSP00000298032
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKYVAEKMGGKIPKEKLPDFSWELHISELKFQLKSNVIPIGHVKKGIFYHRALLFKALADRIGIGCSLVRGEYGRAWNEVMLQNDSRKGVIGGLPAPEMYVIDLMFHPGGLMKLRSREADLYRFI

SEQ ID NO: 6325 - protein, 609 aa, Homo sapiens
  Payload ID: 1373;
  Gene Symbol: ARMC3;
  Gene Name: armadillo repeat containing 3;
  ENSP ID: ENSP00000365711
MDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKYVAEKMGGKIPKEKLPDFSWELHISELKFQLKSNVIPIGHVKKGIFYHRALLFKALADRIGIGCSLVRGEYGRAWNEVMLQNDSRKGVIGGLPAPEMYVIDLMFHPGGLMKLRSREADLYRFI

SEQ ID NO: 6326 - protein, 865 aa, Homo sapiens
  Payload ID: 1373;
  Gene Symbol: ARMC3;
  Gene Name: armadillo repeat containing 3;
  Uniprot ID:  Q5W041;
  ENSP ID: ENSP00000386943
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNNAGFGSPIEDKSEPASGRNTVLSKSATKEKGWRKSKGKKEEEKVKEEEEVMVVPKFVGEGSSDKEWCPPSDPDFSMYVYEVTKSILPITNIKEQIEDLAKYVAEKMGGKIPKEKLPDFSWELHISELKFQLKSNVIPIGHVKKGIFYHRALLFKALADRIGIGCSLVRGEYGRAWNEVMLQNDSRKGVIGGLPAPEMYVIDLMFHPGGLMKLRSREADLYRFI

SEQ ID NO: 6327 - protein, 688 aa, Homo sapiens
  Payload ID: 1373;
  Gene Symbol: ARMC3;
  Gene Name: armadillo repeat containing 3;
  Uniprot ID:  Q5W041;
  ENSP ID: ENSP00000387288
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLPLKELCLQEPSDLRAVLLINSKSYVSPPSSMEDKSDVGYGRSISSSSSLRRSSKEKNKKNSYHFSAGFGSPIEDKSEPASGRNTVLSKSATKEKGWSSLPTSR

SEQ ID NO: 6328 - protein, 118 aa, Homo sapiens
  Payload ID: 1373;
  Gene Symbol: ARMC3;
  Gene Name: armadillo repeat containing 3;
  ENSP ID: ENSP00000396629
MIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPV

SEQ ID NO: 6329 - protein, 1044 aa, Homo sapiens
  Payload ID: 1374;
  Gene Symbol: ARMC4;
  Gene Name: armadillo repeat containing 4;
  Uniprot ID:  Q5T2S8;
  ENSP ID: ENSP00000306410
MGVALRKLTQWTAAGHGTGILEITPLNEAILKEIIVFVESFIYKHPQEAKFVFVEPLEWNTSLAPSAFESGYVVSETTVKSEEVDKNGQPLLFLSVPQIKIRSFGQLSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKGGNQTATVIALCSMRDFSLAQETCQLAIRDVGGLEVLINLLETDEVKCKIGSLKILKEISHNPQIRQNIVDLGGLPIMVNILDSPHKSLKCLAAETIANVAKFKRARRVVRQHGGITKLVALLDCAHDSTKPAQSSLYEARDVEVARCGALALWSCSKSHTNKEAIRKAGGIPLLARLLKTSHENMLIPVVGTLQECASEENYRAAIKAERIIENLVKNLNSENEQLQEHCAMAIYQCAEDKETRDLVRLHGGLKPLASLLNNTDNKERLAAVTGAIWKCSISKENVTKFREYKAIETLVGLLTDQPEEVLVNVVGALGECCQERENRVIVRKCGGIQPLVNLLVGINQALLVNVTKAVGACAVEPESMMIIDRLDGVRLLWSLLKNPHPDVKASAAWALCPCIKNAKDAGEMVRSFVGGLELIVNLLKSDNKEVLASVCAAITNIAKDQENLAVITDHGVVPLLSKLANTNNNKLRHHLAEAISRCCMWGRNRVAFGEHKAVAPLVRYLKSNDTNVHRATAQALYQLSEDADNCITMHENGAVKLLLDMVGSPDQDLQEAAAGCISNIRRLALATEKARYT

SEQ ID NO: 6330 - protein, 389 aa, Homo sapiens
  Payload ID: 1374;
  Gene Symbol: ARMC4;
  Gene Name: armadillo repeat containing 4;
  ENSP ID: ENSP00000398155
LSRLLLIAKTGKLKEAQACVEANRDPIVKILGSDYNTMKENSIALNILGKITRDDDPESEIKMKIAMLLKQLDLHLLNHSLKHISLEISLSPMTVKKDIELLKRFSGKGNQTVLESIEYTSDYEFSNGCRAPPWRQIRGEICYVLVKPHDGETLCITCSAGGVFLNGGKTDDEGDVNYERKGSIYKNLVTFLREKSPKFSENMSKLGISFSEDQQKEKDQLGKAPKKEEAAALRKDISGSDKRSLEKNQINFWRNQMTKRWEPSLNWKTTVNYKGKGSAKEIQEDKHTGKLEKPRPSVSHGRAQLLRKSAEKIEETVSDSSSESEEDEEPPDHRQEASADLPSEYWQIQKLVKYLKQKETSQNGRNKRWIRKQNTRVIRSMIFDVGKTS

SEQ ID NO: 6331 - protein, 57 aa, Homo sapiens
  Payload ID: 1374;
  Gene Symbol: ARMC4;
  Gene Name: armadillo repeat containing 4;
  ENSP ID: ENSP00000473438
MGVALRKLTQWTAAGHGTGILEITPLNEAILKEIIVFVESFIYKHPQEAKFVFVEPL

SEQ ID NO: 6332 - protein, 935 aa, Homo sapiens
  Payload ID: 1375;
  Gene Symbol: ARMC5;
  Gene Name: armadillo repeat containing 5;
  Uniprot ID:  Q96C12;
  ENSP ID: ENSP00000268314
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 6333 - protein, 1030 aa, Homo sapiens
  Payload ID: 1375;
  Gene Symbol: ARMC5;
  Gene Name: armadillo repeat containing 5;
  ENSP ID: ENSP00000386125
MVTLGAGVRLFTGVYPVVLNQIRATSEASAITRTTMPAPELTSTSRAEDTRDTGVQLRKRKIPQARHSRKRQRTFSFRSLGSAARSGAESEARAKMAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 6334 - protein, 725 aa, Homo sapiens
  Payload ID: 1375;
  Gene Symbol: ARMC5;
  Gene Name: armadillo repeat containing 5;
  Uniprot ID:  Q96C12;
  ENSP ID: ENSP00000399561
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGEFPYPPVSLPPCESPSSPMASMGPEPHLPTHLSSPARPPDNLSPEWGGEQGVPVPPWAHRQSSAVSSALALGPRYPNSRCSPAPRIWAGLCFFPGSAIGSALS

SEQ ID NO: 6335 - protein, 771 aa, Homo sapiens
  Payload ID: 1375;
  Gene Symbol: ARMC5;
  Gene Name: armadillo repeat containing 5;
  Uniprot ID:  Q96C12;
  ENSP ID: ENSP00000443995
MKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 6336 - protein, 10 aa, Homo sapiens
  Payload ID: 1375;
  Gene Symbol: ARMC5;
  Gene Name: armadillo repeat containing 5;
  ENSP ID: ENSP00000454430
  MOD_RES (1)..(1): Any amino acid
XLGKCSAPVS

SEQ ID NO: 6337 - protein, 598 aa, Homo sapiens
  Payload ID: 1375;
  Gene Symbol: ARMC5;
  Gene Name: armadillo repeat containing 5;
  ENSP ID: ENSP00000456571
  MOD_RES (1)..(1): Any amino acid
XTEVRRLGGILPLVTILQCMKTDSIQNRTARALGNLAMEPESCGDIHCAGAVPLLVESLTACQDSQCLQSVALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 6338 - protein, 935 aa, Homo sapiens; identical to SEQ ID NO: 6332
  Payload ID: 1375;
  Gene Symbol: ARMC5;
  Gene Name: armadillo repeat containing 5;
  Uniprot ID:  Q96C12;
  ENSP ID: ENSP00000456877

SEQ ID NO: 6339 - protein, 476 aa, Homo sapiens
  Payload ID: 1376;
  Gene Symbol: ARMC6;
  Gene Name: armadillo repeat containing 6;
  Uniprot ID:  Q6NXE6;
  ENSP ID: ENSP00000269932
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 6340 - protein, 476 aa, Homo sapiens; identical to SEQ ID NO: 6339
  Payload ID: 1376;
  Gene Symbol: ARMC6;
  Gene Name: armadillo repeat containing 6;
  Uniprot ID:  Q6NXE6;
  ENSP ID: ENSP00000376147

SEQ ID NO: 6341 - protein, 501 aa, Homo sapiens
  Payload ID: 1376;
  Gene Symbol: ARMC6;
  Gene Name: armadillo repeat containing 6;
  Uniprot ID:  Q6NXE6;
  ENSP ID: ENSP00000376148
MSERCCSRYSSGASIGCTPTSTQAKMVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 6342 - protein, 156 aa, Homo sapiens
  Payload ID: 1376;
  Gene Symbol: ARMC6;
  Gene Name: armadillo repeat containing 6;
  ENSP ID: ENSP00000437580
MLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVM

SEQ ID NO: 6343 - protein, 103 aa, Homo sapiens
  Payload ID: 1376;
  Gene Symbol: ARMC6;
  Gene Name: armadillo repeat containing 6;
  ENSP ID: ENSP00000438369
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACR

SEQ ID NO: 6344 - protein, 63 aa, Homo sapiens
  Payload ID: 1376;
  Gene Symbol: ARMC6;
  Gene Name: armadillo repeat containing 6;
  ENSP ID: ENSP00000439003
MSERCCSRYRDGALLCCPCWSQTPDLKQSSHLGLLKHWDHSSGASIGCTPTSTQAKMVSKRIA

SEQ ID NO: 6345 - protein, 70 aa, Homo sapiens
  Payload ID: 1376;
  Gene Symbol: ARMC6;
  Gene Name: armadillo repeat containing 6;
  ENSP ID: ENSP00000439038
MVSKRIAQETFDAAVRENIEEFAMGPEEAVKEAVEQFESQGVDLSNIVKTAPKVSADGSQEPTHDILQML

SEQ ID NO: 6346 - protein, 161 aa, Homo sapiens
  Payload ID: 1376;
  Gene Symbol: ARMC6;
  Gene Name: armadillo repeat containing 6;
  ENSP ID: ENSP00000439269
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLT

SEQ ID NO: 6347 - protein, 47 aa, Homo sapiens
  Payload ID: 1376;
  Gene Symbol: ARMC6;
  Gene Name: armadillo repeat containing 6;
  ENSP ID: ENSP00000441420
MSERCCSRYRDGVSPRVQAGLKLLASCDPSASASQSAGHHAWPEVET

SEQ ID NO: 6348 - protein, 256 aa, Homo sapiens
  Payload ID: 1376;
  Gene Symbol: ARMC6;
  Gene Name: armadillo repeat containing 6;
  ENSP ID: ENSP00000441948
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIE

SEQ ID NO: 6349 - protein, 30 aa, Homo sapiens
  Payload ID: 1376;
  Gene Symbol: ARMC6;
  Gene Name: armadillo repeat containing 6;
  ENSP ID: ENSP00000442263
MVSKRIAQETFDAAVRENIEEFAMGPEEAV

SEQ ID NO: 6350 - protein, 81 aa, Homo sapiens
  Payload ID: 1376;
  Gene Symbol: ARMC6;
  Gene Name: armadillo repeat containing 6;
  ENSP ID: ENSP00000443719
  MOD_RES (1)..(1): Any amino acid
XKAHPQKAGVQKQACMLIRNLVAHGQAFSKPILDLGAEALIMQARSAHRDCEDVAKAALRDLGCHVELRELWTGQRGNLAP

SEQ ID NO: 6351 - protein, 501 aa, Homo sapiens; identical to SEQ ID NO: 6341
  Payload ID: 1376;
  Gene Symbol: ARMC6;
  Gene Name: armadillo repeat containing 6;
  Uniprot ID:  Q6NXE6;
  ENSP ID: ENSP00000444156

SEQ ID NO: 6352 - protein, 137 aa, Homo sapiens
  Payload ID: 1376;
  Gene Symbol: ARMC6;
  Gene Name: armadillo repeat containing 6;
  ENSP ID: ENSP00000444265
  MOD_RES (1)..(1): Any amino acid
XSGVQELVKQVLSTLRAIAGNDDVKDAIVRAGGTESIVAAMTQHLTSPQVCEQSCAALCFLALRKPDNSRIIVEGGGAVAALQAMKAHPQKAGVQVGRAGDGGRQAGVGCAETGLHADPKPGGPRPGLLEAHPGPGG

SEQ ID NO: 6353 - protein, 43 aa, Homo sapiens
  Payload ID: 1376;
  Gene Symbol: ARMC6;
  Gene Name: armadillo repeat containing 6;
  ENSP ID: ENSP00000444317
MVSKRIAQETFDAAVRENIEEFAMGPEEAVKEAVEQFESQDAQ

SEQ ID NO: 6354 - protein, 408 aa, Homo sapiens
  Payload ID: 1376;
  Gene Symbol: ARMC6;
  Gene Name: armadillo repeat containing 6;
  ENSP ID: ENSP00000444341
MLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATKAFLDNPGILSELCGTLSRLAIRNEFCQEVVDLGGLSILVSLLADCNDHQMRDQSGVQELVKQVLSTLRAIAGNDDVKDAIVRAGGTESIVAAMTQHLTSPQVCEQSCAALCFLALRKPDNSRIIVEGGGAVAALQAMKAHPQKAGVQKQACMLIRNLVAHGQAFSKPILDLGAEALIMQARSAHRDCEDVAKAALRDLGCHVELRELWTGQRGNLAP

SEQ ID NO: 6355 - protein, 70 aa, Homo sapiens
  Payload ID: 1376;
  Gene Symbol: ARMC6;
  Gene Name: armadillo repeat containing 6;
  ENSP ID: ENSP00000444916
MSERCCSRYSQAGVQWHDLGSLQPPPLCSSGSPTSVSLIAGITDLRSIYRLHANINTGEDGLQAHCPGDL

SEQ ID NO: 6356 - protein, 259 aa, Homo sapiens
  Payload ID: 1376;
  Gene Symbol: ARMC6;
  Gene Name: armadillo repeat containing 6;
  ENSP ID: ENSP00000446037
MVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALSVLTDGQPDLLDAQGLQLLVATLTQNADEADLTCSGIRCVRHACLKHEQNRQDLVKAGVLPLLTGAITHHGHHTDVVREACWALRVMTFDDDIRVPFGHAHNHAKMIVQENKGLKVLIEATK

SEQ ID NO: 6357 - protein, 163 aa, Homo sapiens
  Payload ID: 1376;
  Gene Symbol: ARMC6;
  Gene Name: armadillo repeat containing 6;
  ENSP ID: ENSP00000446209
MSERCCSRYSSGASIGCTPTSTQAKMVSKRIAQETFDAAVRENIEEFAMGPEEAVKEAVEQFESQGVDLSNIVKTAPKVSADGSQEPTHDILQMLSDLQESVASSRPQEVSAYLTRFCDQCKQDKACRFLAAQKGAYPIIFTAWKLATAGDQGLLLQSLNALS

SEQ ID NO: 6358 - protein, 145 aa, Homo sapiens
  Payload ID: 1376;
  Gene Symbol: ARMC6;
  Gene Name: armadillo repeat containing 6;
  ENSP ID: ENSP00000446234
  MOD_RES (1)..(1): Any amino acid
XEVVDLGGLSILVSLLADCNDHQMRDQSGVQELVKQVLSTLRAIAGNDDVKDAIVRAGGTESIVAAMTQHLTSPQKQACMLIRNLVAHGQAFSKPILDLGAEALIMQARSAHRDCEDVAKAALRDLGCHVELRELWTGQRGNLAP

SEQ ID NO: 6359 - protein, 198 aa, Homo sapiens
  Payload ID: 1377;
  Gene Symbol: ARMC7;
  Gene Name: armadillo repeat containing 7;
  Uniprot ID:  Q9H6L4;
  ENSP ID: ENSP00000245543
MAQKPKVDPHVGRLGYLQALVTEFQETQSQDAKEQVLANLANFAYDPSNYEYLRQLQVLDLFLDSLSEENETLVEFAIGGLCNLCPDRANKEHILHAGGVPLIINCLSSPNEETVLSAITTLMHLSPPGRSFLPELTATPVVQCMLRFSLSASARLRNLAQIFLEDFCSPRQVAEARSRQAHSALGIPLPRSVAPRQR

SEQ ID NO: 6360 - protein, 82 aa, Homo sapiens
  Payload ID: 1377;
  Gene Symbol: ARMC7;
  Gene Name: armadillo repeat containing 7;
  ENSP ID: ENSP00000462642
MAQKPKVDPHVGRLGYLQALVTEFQETQSQDAKEQVLANLANFAYDPSNYEYLRQLQVLDLFLDSLSEENETLVEFAIAAAV

SEQ ID NO: 6361 - protein, 101 aa, Homo sapiens
  Payload ID: 1377;
  Gene Symbol: ARMC7;
  Gene Name: armadillo repeat containing 7;
  ENSP ID: ENSP00000462939
MAQKPKVDPHVGRLGYLQALVTEFQETQSQDAKEQVLANLANFAYDPSNYEYLRQLQVLDLFLDSLSEENETLVEFAIARPPRPKHSSFLSVESLRGTMLQ

SEQ ID NO: 6362 - protein, 103 aa, Homo sapiens
  Payload ID: 1377;
  Gene Symbol: ARMC7;
  Gene Name: armadillo repeat containing 7;
  Uniprot ID:  Q9H6L4;
  ENSP ID: ENSP00000462962
MAQKPKVDPHVGRLGYLQALVTEFQETQSQDAKEQVLANLANFAYDPSNYEYLRQLQEACATCAQTGPTRSTSCTQEVSHSSSTAYPAPMRRRCCLPSPRSCT

SEQ ID NO: 6363 - protein, 385 aa, Homo sapiens
  Payload ID: 1378;
  Gene Symbol: ARMC8;
  Gene Name: armadillo repeat containing 8;
  Uniprot ID:  Q8IUR7;
  ENSP ID: ENSP00000351221
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKVSLGEGRPPVLTASRQGVTST

SEQ ID NO: 6364 - protein, 600 aa, Homo sapiens
  Payload ID: 1378;
  Gene Symbol: ARMC8;
  Gene Name: armadillo repeat containing 8;
  ENSP ID: ENSP00000417049
MKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 6365 - protein, 631 aa, Homo sapiens
  Payload ID: 1378;
  Gene Symbol: ARMC8;
  Gene Name: armadillo repeat containing 8;
  Uniprot ID:  Q8IUR7;
  ENSP ID: ENSP00000417304
MKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 6366 - protein, 352 aa, Homo sapiens
  Payload ID: 1378;
  Gene Symbol: ARMC8;
  Gene Name: armadillo repeat containing 8;
  ENSP ID: ENSP00000417403
MACLLETPIRMSVLSRHEKCCNWKQQAESQSHCFRSCSKDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFS

SEQ ID NO: 6367 - protein, 90 aa, Homo sapiens
  Payload ID: 1378;
  Gene Symbol: ARMC8;
  Gene Name: armadillo repeat containing 8;
  ENSP ID: ENSP00000417457
  MOD_RES (1)..(1): Any amino acid
XLGLLRNLLSTRPHIDKIMSTHGKQIMQAVTLILEGEHNIEVKEQTLCILANIADGTTAKDLIMTNDDILQKIKYYMGAQTGHLLKSVGS

SEQ ID NO: 6368 - protein, 130 aa, Homo sapiens
  Payload ID: 1378;
  Gene Symbol: ARMC8;
  Gene Name: armadillo repeat containing 8;
  ENSP ID: ENSP00000417699
MKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFS

SEQ ID NO: 6369 - protein, 198 aa, Homo sapiens
  Payload ID: 1378;
  Gene Symbol: ARMC8;
  Gene Name: armadillo repeat containing 8;
  ENSP ID: ENSP00000418074
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLT

SEQ ID NO: 6370 - protein, 399 aa, Homo sapiens
  Payload ID: 1378;
  Gene Symbol: ARMC8;
  Gene Name: armadillo repeat containing 8;
  ENSP ID: ENSP00000418405
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKVSLGEGRPPVLTASRQGVTST

SEQ ID NO: 6371 - protein, 357 aa, Homo sapiens
  Payload ID: 1378;
  Gene Symbol: ARMC8;
  Gene Name: armadillo repeat containing 8;
  ENSP ID: ENSP00000418412
MKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKVSLGEGRPPVLTASRQGVTST

SEQ ID NO: 6372 - protein, 25 aa, Homo sapiens
  Payload ID: 1378;
  Gene Symbol: ARMC8;
  Gene Name: armadillo repeat containing 8;
  ENSP ID: ENSP00000418457
MEVTASSRHYVDRLFDPDPQKVLQG

SEQ ID NO: 6373 - protein, 673 aa, Homo sapiens
  Payload ID: 1378;
  Gene Symbol: ARMC8;
  Gene Name: armadillo repeat containing 8;
  Uniprot ID:  Q8IUR7;
  ENSP ID: ENSP00000419413
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 6374 - protein, 113 aa, Homo sapiens
  Payload ID: 1378;
  Gene Symbol: ARMC8;
  Gene Name: armadillo repeat containing 8;
  ENSP ID: ENSP00000419473
  MOD_RES (1)..(1): Any amino acid
XLLSPDLKFIEACLRCLRTIFTSPVTPEELLYTGPDHQTILFNHGAVQNIAHLLTSLSYKLDHDLKHAHELRQAAFKLYASLGANDEDIRKKVSLGEGRPPVLTASRQGVTST

SEQ ID NO: 6375 - protein, 117 aa, Homo sapiens
  Payload ID: 1378;
  Gene Symbol: ARMC8;
  Gene Name: armadillo repeat containing 8;
  ENSP ID: ENSP00000419888
  MOD_RES (1)..(1): Any amino acid
XLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNV

SEQ ID NO: 6376 - protein, 659 aa, Homo sapiens
  Payload ID: 1378;
  Gene Symbol: ARMC8;
  Gene Name: armadillo repeat containing 8;
  Uniprot ID:  Q8IUR7;
  ENSP ID: ENSP00000420333
MEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 6377 - protein, 385 aa, Homo sapiens; identical to SEQ ID NO: 6363
  Payload ID: 1378;
  Gene Symbol: ARMC8;
  Gene Name: armadillo repeat containing 8;
  Uniprot ID:  Q8IUR7;
  ENSP ID: ENSP00000420440

SEQ ID NO: 6378 - protein, 606 aa, Homo sapiens
  Payload ID: 1378;
  Gene Symbol: ARMC8;
  Gene Name: armadillo repeat containing 8;
  Uniprot ID:  Q8IUR7;
  ENSP ID: ENSP00000420706
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTDATVIPHLMALLSRSRYTQEYICQIFSHCCKGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 6379 - protein, 227 aa, Homo sapiens
  Payload ID: 1378;
  Gene Symbol: ARMC8;
  Gene Name: armadillo repeat containing 8;
  ENSP ID: ENSP00000420719
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTGPDHQTILFNHGAVQNIAHLLTSLSYKVRMQALKCFSVLAFENPQVSMTLVNVLVDGELLPQIFVKMLQRDKPIEMQLTSAK

SEQ ID NO: 6380 - protein, 642 aa, Homo sapiens
  Payload ID: 1378;
  Gene Symbol: ARMC8;
  Gene Name: armadillo repeat containing 8;
  Uniprot ID:  Q8IUR7;
  ENSP ID: ENSP00000441592
MACLLETPIRMSVLSEVTASSRHYVDRLFDPDPQKVLQGVIDMKNAVIGNNKQKANLIVLGAVPRLLYLLQQETSSTELKTECAVVLGSLAMGTENNVKSLLDCHIIPALLQGLLSPDLKFIEACLRCLRTIFTSPVTPEELLYTGPDHQTILFNHGAVQNIAHLLTSLSYKVRMQALKCFSVLAFENPQVSMTLVNVLVDGELLPQIFVKMLQRDKPIEMQLTSAKCLTYMCRAGAIRTDDNCIVLKTLPCLVRMCSKERLLEERVEGAETLAYLIEPDVELQRIASITDHLIAMLADYFKYPSSVSAITDIKRLDHDLKHAHELRQAAFKLYASLGANDEDIRKKIIETENMMDRIVTGLSESSVKVRLAAVRCLHSLSRSVQQLRTSFQDHAVWKPLMKVLQNAPDEILVVASSMLCNLLLEFSPSKEPILESGAVELLCGLTQSENPALRVNGIWALMNMAFQAEQKIKADILRSLSTEQLFRLLSDSDLNVLMKTLGLLRNLLSTRPHIDKIMSTHGKQIMQAVTLILEGEHNIEVKEQTLCILANIADGTTAKDLIMTNDDILQKIKYYMGHSHVKLQLAAMFCISNLIWNEEEGSQERQDKLRDMGIVDILHKLSQSPDSNLCDKAKMALQQYLA

SEQ ID NO: 6381 - protein, 665 aa, Homo sapiens
  Payload ID: 1379;
  Gene Symbol: ARMC9;
  Gene Name: armadillo repeat containing 9;
  Uniprot ID:  Q7Z3E5;
  ENSP ID: ENSP00000258417
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKELFQDSWTPELKLKLIKFLALISKASNTPKLLTIYKENGQSNKEILQQLHQQLVEAERRSVTYLKRYNKIQADYHNLIGVTAELVDSLEATVSGKMITPEYLQSVCVRLFSNQMRQSLAHSVDFTRPGTASTMLRASLAPVKLKDVPLLPSLDYEKLKKDLILGSDRLKAFLLQALRWRLTTSHPGEQRETVLQAYISNDLLDCYSHNQRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRSTGKNMCAKVAGLVLKVLSDLLGHENHEIQPYVNGALYSILSVPSIREEARAMGMEDILRCFIKEGNAEMIRQIEFIIKQLNSEELPDGVLESDDDEDEDDEEDHDIMEADLDKDELIQPQLGELSGEKLLTTEYLGIMTNTGKTRRKGLANVQWSGDEPLQRPVTPGGHRNGYPV

SEQ ID NO: 6382 - protein, 166 aa, Homo sapiens
  Payload ID: 1379;
  Gene Symbol: ARMC9;
  Gene Name: armadillo repeat containing 9;
  ENSP ID: ENSP00000387391
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKEL

SEQ ID NO: 6383 - protein, 172 aa, Homo sapiens
  Payload ID: 1379;
  Gene Symbol: ARMC9;
  Gene Name: armadillo repeat containing 9;
  ENSP ID: ENSP00000388527
  MOD_RES (1)..(1): Any amino acid
XRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRSTGKNMCAKVAGLVLKVLSDLLGHENHEIQPYVNGALYSILSVPSIREEARAMVP

SEQ ID NO: 6384 - protein, 208 aa, Homo sapiens
  Payload ID: 1379;
  Gene Symbol: ARMC9;
  Gene Name: armadillo repeat containing 9;
  ENSP ID: ENSP00000392086
SLEATVSGKMASTMLRASLAPVKLKDVPLLPSLDYEKLKKDLILGSDRLKAFLLQALRWRLTTSHPGEQRETVLQAYISNDLLDCYSHNQRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRST

SEQ ID NO: 6385 - protein, 73 aa, Homo sapiens
  Payload ID: 1379;
  Gene Symbol: ARMC9;
  Gene Name: armadillo repeat containing 9;
  ENSP ID: ENSP00000407146
ELVDSLEATVSGKMITPEYLQSVCVRLFSNQMRQSLAHSVDFTRPGTVRLCAQGRVPVVYPPKFKKNVTLKIA

SEQ ID NO: 6386 - protein, 158 aa, Homo sapiens
  Payload ID: 1379;
  Gene Symbol: ARMC9;
  Gene Name: armadillo repeat containing 9;
  ENSP ID: ENSP00000411778
MCLGSAILTWKTAATRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRSTGKNMCAKVAGLVLKVLSDLLGHENH

SEQ ID NO: 6387 - protein, 194 aa, Homo sapiens
  Payload ID: 1379;
  Gene Symbol: ARMC9;
  Gene Name: armadillo repeat containing 9;
  ENSP ID: ENSP00000413932
  MOD_RES (1)..(1): Any amino acid
XELVLLSRKLKDVPLLPSLDYEKLKKDLILGSDRLKAFLLQALRWRLTTSHPGEQRETVLQAYISNDLLDCYSHNQRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRST

SEQ ID NO: 6388 - protein, 818 aa, Homo sapiens
  Payload ID: 1379;
  Gene Symbol: ARMC9;
  Gene Name: armadillo repeat containing 9;
  ENSP ID: ENSP00000484241
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKELFQDSWTPELKLKLIKFLALISKASNTPKLLTIYKENGQSNKEILQQLHQQLVEAERRSVTYLKRYNKIQADYHNLIGVTAELVDSLEATVSGKMITPEYLQSVCVRLFSNQMRQSLAHSVDFTRPGTASTMLRASLAPVKLKDVPLLPSLDYEKLKKDLILGSDRLKAFLLQALRWRLTTSHPGEQRETVLQAYISNDLLDCYSHNQRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRSTGKNMCAKVAGLVLKVLSDLLGHENHEIQPYVNGALYSILSVPSIREEARAMGMEDILRCFIKEGNAEMIRQIEFIIKQLNSEELPDGVLESDDDEDEDDEEDHDIMEADLDKDELIQPQLGELSGEKLLTTEYLGIMTNTGKTRRKGLANVQWSGDEPLQRPVTPGGHRNGYPVVEDQHTPPQTAQHARNGHPQALPAAHEAVYREGKPSTPESCVSSSSAIIAKPGEWLPRGRQEEPRPAPTGTPRQPREAPQDPGNGVTTRECASAFTCKPRAPCTPEMLDWNPPKAKASVLAPLFSSCGPQQASRPGSTASSTRGLPSSQSHRK

SEQ ID NO: 6389 - protein, 818 aa, Homo sapiens; identical to SEQ ID NO: 6388
  Payload ID: 1379;
  Gene Symbol: ARMC9;
  Gene Name: armadillo repeat containing 9;
  ENSP ID: ENSP00000484804

SEQ ID NO: 6390 - protein, 453 aa, Homo sapiens
  Payload ID: 1380;
  Gene Symbol: ARMCX1;
  Gene Name: armadillo repeat containing, X-linked 1;
  Uniprot ID:  Q9P291;
  ENSP ID: ENSP00000361917
MGRTREAGCVAAGVVIGAGACYCVYRLAWGRDENEKIWDEDEESTDTSEIGVETVKGAKTNAGAGSGAKLQGDSEVKPEVSLGLEDCPGVKEKAHSGSHSGGGLEAKAKALFNTLKEQASAKAGKGARVGTISGNRTLAPSLPCPGGRGGGCHPTRSGSRAGGRASGKSKGKARSKSTRAPATTWPVRRGKFNFPYKIDDILSAPDLQKVLNILERTNDPFIQEVALVTLGNNAAYSFNQNAIRELGGVPIIAKLIKTKDPIIREKTYNALNNLSVNAENQGKIKTYISQVCDDTMVCRLDSAVQMAGLRLLTNMTVTNHYQHLLSYSFPDFFALLFLGNHFTKIQIMKLIINFTENPAMTRELVSCKVPSELISLFNKEWDREILLNILTLFENINDNIKNEGLASSRKEFSRSSLFFLFKESGVCVKKIKALANHNDLVVKVKVLKVLTKL

SEQ ID NO: 6391 - protein, 365 aa, Homo sapiens
  Payload ID: 1380;
  Gene Symbol: ARMCX1;
  Gene Name: armadillo repeat containing, X-linked 1;
  ENSP ID: ENSP00000477961
MGRTREAGCVAAGVVIGAGACYCVYRLAWGRDENEKIWDEDEESTDTSEIGVETVKGAKTNAGAGSGAKLQGDSEVKPEVSLGLEDCPGVKEKAHSGSHSGGGLEAKAKALFNTLKEQASAKAGKGARVGTISGNRTLAPSLPCPGGRGGGCHPTRSGSRAGGRASGKSKGKARSKSTRAPATTWPVRRGKFNFPYKIDDILSAPDLQKVLNILERTNDPFIQEVALVTLGNNAAYSFNQNAIRELGGVPIIAKLIKTKDPIIREKTYNALNNLSVNAENQGKIKTYISQVCDDTMVCRLDSAVQMAGLRLLTNMTVTNHYQHLLSYSFPDFFALLFLGNHFTKIQIMKLIINFTENPAMTAGQL

SEQ ID NO: 6392 - protein, 632 aa, Homo sapiens
  Payload ID: 1381;
  Gene Symbol: ARMCX2;
  Gene Name: armadillo repeat containing, X-linked 2;
  Uniprot ID:  Q7L311;
  ENSP ID: ENSP00000328631
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAEAPREAETSRAAVPPGTVVPTEAAAPTEVTEGPGVAAPTKVAEAPGVASPTEAAEAPVPATPTGAAAPTGAAESPGTSGSPRTAVVPGTSAAKKATPGAHTGAIPKATSATGAVPKGGGKGVTRSRNGGKGKGKKSKVEVDELGMGFRPGDGAAAAAAASANGGQAFLAEVPDSEEGESGWTDTESDSDSEPETQRRGRGRRPVAMQKRPFPYEIDEILGVRDLRKVLALLQKSDDPFIQQVALLTLSNNANYSCNQETIRKLGGLPIIANMINKTDPHIKEKALMAMNNLSENYENQGRLQVYMNKVMDDIMASNLNSAVQVVGLKFLTNMTITNDYQHLLVNSIANFFRLLSQGGGKIKVEILKILSNFAENPDMLKKLLSTQVPASFSSLYNSYVESEILINALTLFEIIYDNLRAEVFNYREFNKGSLFYLCTTSGVCVKKIRALANHHDLLVKVKVIKLVNKF

SEQ ID NO: 6393 - protein, 632 aa, Homo sapiens; identical to SEQ ID NO: 6392
  Payload ID: 1381;
  Gene Symbol: ARMCX2;
  Gene Name: armadillo repeat containing, X-linked 2;
  Uniprot ID:  Q7L311;
  ENSP ID: ENSP00000331662

SEQ ID NO: 6394 - protein, 632 aa, Homo sapiens; identical to SEQ ID NO: 6392
  Payload ID: 1381;
  Gene Symbol: ARMCX2;
  Gene Name: armadillo repeat containing, X-linked 2;
  Uniprot ID:  Q7L311;
  ENSP ID: ENSP00000349281

SEQ ID NO: 6395 - protein, 104 aa, Homo sapiens
  Payload ID: 1381;
  Gene Symbol: ARMCX2;
  Gene Name: armadillo repeat containing, X-linked 2;
  ENSP ID: ENSP00000393778
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASS

SEQ ID NO: 6396 - protein, 62 aa, Homo sapiens
  Payload ID: 1381;
  Gene Symbol: ARMCX2;
  Gene Name: armadillo repeat containing, X-linked 2;
  ENSP ID: ENSP00000405376
MSRVRDAGCVAAGIVIGAGAWYCVYKYTRGRDQTKKRMAKPKNRAVAGTGARARAGLRAGFT

SEQ ID NO: 6397 - protein, 165 aa, Homo sapiens
  Payload ID: 1381;
  Gene Symbol: ARMCX2;
  Gene Name: armadillo repeat containing, X-linked 2;
  ENSP ID: ENSP00000410151
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAE

SEQ ID NO: 6398 - protein, 167 aa, Homo sapiens
  Payload ID: 1381;
  Gene Symbol: ARMCX2;
  Gene Name: armadillo repeat containing, X-linked 2;
  ENSP ID: ENSP00000412481
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAEAP

SEQ ID NO: 6399 - protein, 92 aa, Homo sapiens
  Payload ID: 1381;
  Gene Symbol: ARMCX2;
  Gene Name: armadillo repeat containing, X-linked 2;
  ENSP ID: ENSP00000415490
MSRVRDAGCVAAGIVIGAGAWYCVYKYTRGRDQTKKRMAKPKNRAVAGTGARARAGLRAGFTIDLGSGFSPPTPVRAEAEDRAQDEASALDT

SEQ ID NO: 6400 - protein, 379 aa, Homo sapiens
  Payload ID: 1382;
  Gene Symbol: ARMCX3;
  Gene Name: armadillo repeat containing, X-linked 3;
  Uniprot ID:  Q9UH62;
  ENSP ID: ENSP00000340672
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAGNEETKLQVLKLLLNLAENPAMTRELLRAQVPSSLGSLFNKKENKEVILKLLVIFENINDNFKWEENEPTQNQFGEGSLFFFLKEFQVCADKVLGIESHHDFLVKVKVGKFMAKLAEHMFPKSQE

SEQ ID NO: 6401 - protein, 379 aa, Homo sapiens; identical to SEQ ID NO: 6400
  Payload ID: 1382;
  Gene Symbol: ARMCX3;
  Gene Name: armadillo repeat containing, X-linked 3;
  Uniprot ID:  Q9UH62;
  ENSP ID: ENSP00000439032

SEQ ID NO: 6402 - protein, 63 aa, Homo sapiens
  Payload ID: 1382;
  Gene Symbol: ARMCX3;
  Gene Name: armadillo repeat containing, X-linked 3;
  ENSP ID: ENSP00000454251
MGYARKVGWVTAGLVIGAGACYCIYRLTRGRKQNKEKMAEGGSGDVDDAGDCSGARYNDWSDD

SEQ ID NO: 6403 - protein, 379 aa, Homo sapiens; identical to SEQ ID NO: 6400
  Payload ID: 1382;
  Gene Symbol: ARMCX3;
  Gene Name: armadillo repeat containing, X-linked 3;
  Uniprot ID:  Q9UH62;
  ENSP ID: ENSP00000454483

SEQ ID NO: 6404 - protein, 94 aa, Homo sapiens
  Payload ID: 1382;
  Gene Symbol: ARMCX3;
  Gene Name: armadillo repeat containing, X-linked 3;
  ENSP ID: ENSP00000457997
MGYARKVGWVTAGLVIGAGACYCIYRLTRGRKQNKEKMAEGGSGDVDDAGDCSGARYNDWSDDDDDSNESKSIVWYPPWARIGTEAGTRARARA

SEQ ID NO: 6405 - protein, 2290 aa, Homo sapiens
  Payload ID: 1383;
  Gene Symbol: ARMCX4;
  Gene Name: armadillo repeat containing, X-linked 4;
  ENSP ID: ENSP00000404304
MGRIQEVGWVTAGLVIWAGTCYYIYKFTKGRAQSVRTLARNGSTVKMETVVGVQSQTLAINEAEIKTKPQVEIGAETGARSGPRAEVETKATAIAIHRANSQAKAMVGAEPETQSESKVVAGTLVMTEAVTLTEVKAKAREVAMKEAVTQTDAEAGKIVKKEAVTQTKAKAWALVAKTEAKREAMTQTKAETHILAEKETEINRVMVTQSETLAVPREVAKMGATNKTGIVDETKTRALEETVSVAKTQSEARPGATVDARGNPNGMSREVAGVDMKSCAQSQAVTKIQGDDMPGTGVEDMGNCKTMSRAESGADTRASAQPQIFAKTQTEAIPGAKIDAGGNTNAMCKVGAGADVRACIQPQTVAKKQAEVTSGARVDGRGNTNVISKAITGADMRAAAQPQAVASTHAEAMSDAKVKNRGNPNAMTKAGAKANLRANSQVEALPDARDKSRGNPNVMAKVGDGTDMLSCTQPQLVASVQADTLSDGKIKVRGNVNTMPKEGAGVDMKAQGMAQSQGEALPNTRGKARGKAKAKCKTGPGMDMKTCTQPQAGVKTPAEALLDSRVDGRGNPNATSKAGTKADQRVCGQPLVVANPQGEALPGAKNKVKGNPHTVLKVGAGEGTTDSAQPEAVVSFQGEALLGTKNKVKGNPNVVLKAEVGEGAMGTAQLQIMASSKGEALLDSKNKVKGNSNAVSKAGAGTDTTGSVQPQIVANSQGEVLPGAKNKIRGNPTTVPNSGVGPYTTDSARLQAVANSQGEVLPGAKNKVKANLNAVSKAEAGMGATGSVQPQAVANSHCETLPGAKNKVRGNWNAVSKAGAGMDTRGSAQPQAVANSQGEVLPGAKNKVKGNPNVVSKAGAREDTVGSTQPQVLASSQRETLPGARNKVKGNSNVVSKAGAREDTMGSAQPQVVANSQRETLPGARNKVKGNSNAISKAEAGAGIMGSVQVQVVASFQGEVLPGAKNKVRGNSNAVPKAEAGADTVGSAQPQAVANSQSETLLGARNKVKGNTIAVPKAGTGAGTRHSAQPQIVAGSQGETLPGARDKSMSTSEAEATAEDEAYAKPEAEAMPTSESEGGSGTQACRKTQPNIHDYYWNGIGVEDWIAAERWIKFRFQTMDGDWENSVSWADDENEASIGSWSGASDKAGIIRSWAVACDETSVKSWAGARAENVVGIGTWARAGEQASGGLWAGGQTSEGTWAGDKASGGAWTGAENQASGGSWALAGNQAIGELWAAGQASDGSWPGGQASGVSWVGEEAIGGSWTGAENQASEGSWAGAGAGNMSSVSYWAGVVDQAGGGSWAGTSDQSGGGSKPRFEDQASGEGSWAGAGGQASGGSMLGPEDQSSGRSWADTADQASGGSRLGHVDQSSGGAWAGTLDQSGGGSKPRFENQTTEEGSWAGAGGQAGGGSKVGPEDQSSGRSWANSGDQISGGFLVGIVDQANGGSWTGAGHPASVGPKPIFEDQVSGRGSWADAREQVVGDSRLGLRDQSSGDSWAGTGDQASGWFCVCPGSQTNGGSWGGASGQDVGGSRPGPTNQSSAGSWDSPGSQVSGSCWTGAGAVDQAGGCSKPGFEDQAIGGGFWPGAGDQTGGGSRPGSEDQSSGIGSWGVAGGQVLGGARPGPADQSSGGSWAGTGNQSSGRSWIGPGDQAVDCSKPEFEDQACGGGSWAGAGSQASGESWAGSRPGNEAIGGSRMGSEDQATGGSWARSEDQASGRFQVSFEVEANEGFWFGPGAEAVIGSWCWTEEKADIVSRPDDKDEATTASRSGAGEEAMICSRIEAENKASSGSWIRSEEVAYMGSCVGAEAGAGAEAGAGAEAGAGAGAEAGAEAGAGAGAGPGTESGAGIWSWDGDATTVESRLGAGEEAGVESWTLARNVGEDELSRESSPDIEEISLRSLFWAESENSNTFRSKSGKDASFESGAGDNTSIKDKFEAAGGVDIGSWFCAGNENTSEDKSAPKAKAKKSSESRGIYPYMVPGAGMGSWDGAMIWSETKFAHQSEASFPVEDESRKQTRTGEKTRPWSCRCKHEANMDPRDLEKLICMIEMTEDPSVHEIANNALYNSADYSYSHEVVRNVGGISVIESLLNNPYPSVRQKALNALNNISVAAENHRKVKTYLNQVCEDTVTYPLNSNVQLAGLRLIRHLTITSEYQHMVTNYISEFLRLLTVGSGETKDHVLGMLLNFSKNPSMTKDLLIANAPTSLINIFSKKETKENILNALSLFENINYHFKRRAKAFTQDKFSKNSLYFLFQRPKACAKKLRALAAECNDPEVKERVELLISKL

SEQ ID NO: 6406 - protein, 51 aa, Homo sapiens
  Payload ID: 1383;
  Gene Symbol: ARMCX4;
  Gene Name: armadillo repeat containing, X-linked 4;
  ENSP ID: ENSP00000422573
MSAAGLKITGSKETKRRLLLISIDWVYCQEKQEERRELPRIITGVDPKSIP

SEQ ID NO: 6407 - protein, 348 aa, Homo sapiens
  Payload ID: 1383;
  Gene Symbol: ARMCX4;
  Gene Name: armadillo repeat containing, X-linked 4;
  Uniprot ID:  Q5H9R4;
  ENSP ID: ENSP00000423440
MSAAGLKITGSKETKRRLLLISIDWVYCQEKQEERRELPRIITGPPPEAAVVAFEWLKTSTLTGLHPQLPLSLPQPECALPYLVRAFSRGDYMGRIQEVGWVTAGLVIWAGTCYYIYKFTKGRAQSVRTLARNGSTVKMETVVGVQSQTLAINEAEIKTKPQVEIGAETGARSGPRAEVETKATAIAIHRANSQAKAMVGAEPETQSESKVVAGTLVMTEAVTLTEVKAKAREVAMKEAVTQTDAEAGKIVKKEAVTQTKAKAWALVAKTEAKREAMTQTKAETHILAEKETEINRVMVTQSETLAVPREVAKMGATNKTGIVDETKTRALEETVLIPRAFPSKNASC

SEQ ID NO: 6408 - protein, 348 aa, Homo sapiens; identical to SEQ ID NO: 6407
  Payload ID: 1383;
  Gene Symbol: ARMCX4;
  Gene Name: armadillo repeat containing, X-linked 4;
  Uniprot ID:  Q5H9R4;
  ENSP ID: ENSP00000423927

SEQ ID NO: 6409 - protein, 360 aa, Homo sapiens
  Payload ID: 1383;
  Gene Symbol: ARMCX4;
  Gene Name: armadillo repeat containing, X-linked 4;
  Uniprot ID:  Q5H9R4;
  ENSP ID: ENSP00000424452
MSAAGLKITGSKETKRRLLLISIDWSRDLMNLCIYFRVYCQEKQEERRELPRIITGPPPEAAVVAFEWLKTSTLTGLHPQLPLSLPQPECALPYLVRAFSRGDYMGRIQEVGWVTAGLVIWAGTCYYIYKFTKGRAQSVRTLARNGSTVKMETVVGVQSQTLAINEAEIKTKPQVEIGAETGARSGPRAEVETKATAIAIHRANSQAKAMVGAEPETQSESKVVAGTLVMTEAVTLTEVKAKAREVAMKEAVTQTDAEAGKIVKKEAVTQTKAKAWALVAKTEAKREAMTQTKAETHILAEKETEINRVMVTQSETLAVPREVAKMGATNKTGIVDETKTRALEETVLIPRAFPSKNASC

SEQ ID NO: 6410 - protein, 360 aa, Homo sapiens; identical to SEQ ID NO: 6409
  Payload ID: 1383;
  Gene Symbol: ARMCX4;
  Gene Name: armadillo repeat containing, X-linked 4;
  Uniprot ID:  Q5H9R4;
  ENSP ID: ENSP00000425302

SEQ ID NO: 6411 - protein, 51 aa, Homo sapiens; identical to SEQ ID NO: 6406
  Payload ID: 1383;
  Gene Symbol: ARMCX4;
  Gene Name: armadillo repeat containing, X-linked 4;
  ENSP ID: ENSP00000426585

SEQ ID NO: 6412 - protein, 558 aa, Homo sapiens
  Payload ID: 1384;
  Gene Symbol: ARMCX5;
  Gene Name: armadillo repeat containing, X-linked 5;
  Uniprot ID:  Q6P1M9;
  ENSP ID: ENSP00000246174
MVDSGTEARARGKAEAGLQDGISGPATARVNGKTQAEAVAEAELKTESVTQAKAGDGAMTRTHTVTYREAMAVTREVIKVEDTTKTRVMVETKTKPLAERSIVPQTKSKAMPMSRVSTVTKSEVKVVAVIEANIRSYAKSHDKANTGSRPDRREETSIGMKSSDEDEENICSWFWTGEEPSVGSWFWPEEETSLQVYKPLPKIQEKPKPTHKPTLTIKQKVIAWSRARYIVLVPVEGGEQSLPPEGNWTLVETLIETPLGIRPLTKIPPYHGPYYQTLAEIKKQIRQREKYGPNPKACHCKSRGFSLEPKEFDKLVALLKLTKDPFIHEIATMIMGISPAYPFTQDIIHDVGITVMIENLVNNPNVKEHPGALSMVDDSSESSEEPKSGESYIHQVCKGIISCPLNSPVQLAGLKLLGHLSIKFEDHYVITSYIPDFLTLLNKGSVKTKFYVLKVFSCLSKNHANTRELISAKVLSSLVAPFNKNESKANILNIIEIFENINFQFKTKAKLFTKEKFTKSELISIFQEAKQFGQKLQDLAEHSDPEVRDKVIRLILKL

SEQ ID NO: 6413 - protein, 558 aa, Homo sapiens; identical to SEQ ID NO: 6412
  Payload ID: 1384;
  Gene Symbol: ARMCX5;
  Gene Name: armadillo repeat containing, X-linked 5;
  Uniprot ID:  Q6P1M9;
  ENSP ID: ENSP00000361827

SEQ ID NO: 6414 - protein, 7 aa, Homo sapiens
  Payload ID: 1384;
  Gene Symbol: ARMCX5;
  Gene Name: armadillo repeat containing, X-linked 5;
  ENSP ID: ENSP00000473737
MVDSGTE

SEQ ID NO: 6415 - protein, 68 aa, Homo sapiens
  Payload ID: 1384;
  Gene Symbol: ARMCX5;
  Gene Name: armadillo repeat containing, X-linked 5;
  ENSP ID: ENSP00000474470
MVDSGTEARARGKAEAGLQDGISGPATARVNGKTQAEAVAEAELKTESVTQAKAGDGAMTRTHTVTYR

SEQ ID NO: 6416 - protein, 71 aa, Homo sapiens
  Payload ID: 1384;
  Gene Symbol: ARMCX5;
  Gene Name: armadillo repeat containing, X-linked 5;
  ENSP ID: ENSP00000474484
MVDSGTEARARGKAEAGLQDGISGPATARVNGKTQAEAVAEAELKTESVTQAKAGDGAMTRTHTVTYREAM

SEQ ID NO: 6417 - protein, 558 aa, Homo sapiens; identical to SEQ ID NO: 6412
  Payload ID: 1384;
  Gene Symbol: ARMCX5;
  Gene Name: armadillo repeat containing, X-linked 5;
  Uniprot ID:  Q6P1M9;
  ENSP ID: ENSP00000474720

SEQ ID NO: 6418 - protein, 300 aa, Homo sapiens
  Payload ID: 1385;
  Gene Symbol: ARMCX6;
  Gene Name: armadillo repeat containing, X-linked 6;
  Uniprot ID:  Q7L4S7;
  ENSP ID: ENSP00000354708
MGRAREVGWMAAGLMIGAGACYCVYKLTIGRDDSEKLEEEGEEEWDDDQELDEEEPDIWFDFETMARPWTEDGDWTEPGAPGGTEDRPSGGGKANRAHPIKQRPFPYEHKNTWSAQNCKNGSCVLDLSKCLFIQGKLLFAEPKDAGFPFSQDINSHLASLSMARNTSPTPDPTVREALCAPDNLNASIESQGQIKMYINEVCRETVSRCCNSFLQQAGLNLLISMTVINNMLAKSASDLKFPLISEGSGCAKVQVLKPLMGLSEKPVLAGELVGAQMLFSFMSLFIRNGNREILLETPAP

SEQ ID NO: 6419 - protein, 300 aa, Homo sapiens; identical to SEQ ID NO: 6418
  Payload ID: 1385;
  Gene Symbol: ARMCX6;
  Gene Name: armadillo repeat containing, X-linked 6;
  Uniprot ID:  Q7L4S7;
  ENSP ID: ENSP00000440648

SEQ ID NO: 6420 - protein, 300 aa, Homo sapiens; identical to SEQ ID NO: 6418
  Payload ID: 1385;
  Gene Symbol: ARMCX6;
  Gene Name: armadillo repeat containing, X-linked 6;
  Uniprot ID:  Q7L4S7;
  ENSP ID: ENSP00000444537

SEQ ID NO: 6421 - protein, 962 aa, Homo sapiens
  Payload ID: 1386;
  Gene Symbol: ARVCF;
  Gene Name: armadillo repeat gene deleted in velocardiofacial syndrome;
  Uniprot ID:  O00192;
  ENSP ID: ENSP00000263207
MEDCNVHSAASILASVKEQEARFERLTRALEQERRHVALQLERAQQPGMVSGGMGSGQPLPMAWQQLVLQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEEWFHQGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 6422 - protein, 899 aa, Homo sapiens
  Payload ID: 1386;
  Gene Symbol: ARVCF;
  Gene Name: armadillo repeat gene deleted in velocardiofacial syndrome;
  Uniprot ID:  O00192;
  ENSP ID: ENSP00000384341
MPAELRQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKEEWFHQGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 6423 - protein, 893 aa, Homo sapiens
  Payload ID: 1386;
  Gene Symbol: ARVCF;
  Gene Name: armadillo repeat gene deleted in velocardiofacial syndrome;
  ENSP ID: ENSP00000384732
MPAELRQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 6424 - protein, 956 aa, Homo sapiens
  Payload ID: 1386;
  Gene Symbol: ARVCF;
  Gene Name: armadillo repeat gene deleted in velocardiofacial syndrome;
  ENSP ID: ENSP00000385444
MEDCNVHSAASILASVKEQEARFERLTRALEQERRHVALQLERAQQPGMVSGGMGSGQPLPMAWQQLVLQEQSPGSQASLATMPEAPDVLEETVTVEEDPGTPTSHVSIVTSEDGTTRRTETKVTKTVKTVTTRTVRQVPVGPDGLPLLDGGPPLGPFADGALDRHFLLRGGGPVATLSRAYLSSGGGFPEGPEPRDSPSYGSLSRGLGMRPPRAGPLGPGPGDGCFTLPGHREAFPVGPEPGPPGGRSLPERFQAEPYGLEDDTRSLAADDEGGPELEPDYGTATRRRPECGRGLHTRAYEDTADDGGELADERPAFPMVTAPLAQPERGSMGSLDRLVRRSPSVDSARKEPRWRDPELPEVLAMLRHPVDPVKANAAAYLQHLCFENEGVKRRVRQLRGLPLLVALLDHPRAEVRRRACGALRNLSYGRDTDNKAAIRDCGGVPALVRLLRAARDNEVRELVTGTLWNLSSYEPLKMVIIDHGLQTLTHEVIVPHSGWEREPNEDSKPRDAEWTTVFKNTSGCLRNVSSDGAEARRRLRECEGLVDALLHALQSAVGRKDTDNKSVENCVCIMRNLSYHVHKEVPGADRYQEAEPGPLGSAVGSQRRRRDDASCFGGKKAKGKKDGEMDRNFDTLDLPKRTEAAKGFELLYQPEVVRLYLSLLTESRNFNTLEAAAGALQNLSAGNWMWATYIRATVRKERGLPVLVELLQSETDKVVRAVAIALRNLSLDRRNKDLIGSYAMAELVRNVRNAQAPPRPGACLEEDTVVAVLNTIHEIVSDSLDNARSLLQARGVPALVALVASSQSVREAKAASHVLQTVWSYKELRGTLQKDGWTKARFQSAAATAKGPKGALSPGGFDDSTLPLVDKSLEGEKTGSRDVIPMDALGPDGYSTVDRRERRPRGASSAGEASEKEPLKLDPSRKAPPPGPSRPAVRLVDAVGDAKPQPVDSWV

SEQ ID NO: 6425 - protein, 376 aa, Homo sapiens
  Payload ID: 1387;
  Gene Symbol: ACTR1A;
  Gene Name: ARP1 actin-related prt 1 homolog A, centractin alpha (yeast);
  Uniprot ID:  P61163;
  ENSP ID: ENSP00000358921
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 6426 - protein, 332 aa, Homo sapiens
  Payload ID: 1387;
  Gene Symbol: ACTR1A;
  Gene Name: ARP1 actin-related prt 1 homolog A, centractin alpha (yeast);
  ENSP ID: ENSP00000473334
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKDICTSGETVFHVDWGLHPCLPGHL

SEQ ID NO: 6427 - protein, 376 aa, Homo sapiens
  Payload ID: 1388;
  Gene Symbol: ACTR1B;
  Gene Name: ARP1 actin-related prt 1 homolog B, centractin beta (yeast);
  Uniprot ID:  P42025;
  ENSP ID: ENSP00000289228
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFANIVLSGGSTLFKGFGDRLLSEVKKLAPKDIKIKISAPQERLYSTWIGGSILASLDTFKKMWVSKKEYEEDGSRAIHRKTF

SEQ ID NO: 6428 - protein, 394 aa, Homo sapiens
  Payload ID: 1389;
  Gene Symbol: ACTR2;
  Gene Name: ARP2 actin-related prt 2 homolog (yeast);
  Uniprot ID:  P61160;
  ENSP ID: ENSP00000260641
MDSQGRKVVVCDNGTGFVKCGYAGSNFPEHIFPALVGRPIIRSTTKVGNIEIKDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 6429 - protein, 399 aa, Homo sapiens
  Payload ID: 1389;
  Gene Symbol: ACTR2;
  Gene Name: ARP2 actin-related prt 2 homolog (yeast);
  Uniprot ID:  P61160;
  ENSP ID: ENSP00000367220
MDSQGRKVVVCDNGTGFVKCGYAGSNFPEHIFPALVGRPIIRSTTKVGNIEIKNNKKMDLMVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 6430 - protein, 339 aa, Homo sapiens
  Payload ID: 1389;
  Gene Symbol: ACTR2;
  Gene Name: ARP2 actin-related prt 2 homolog (yeast);
  ENSP ID: ENSP00000437383
MVGDEASELRSMLEVNYPMENGIVRNWDDMKHLWDYTFGPEKLNIDTRNCKILLTEPPMNPTKNREKIVEVMFETYQFSGVYVAIQAVLTLYAQGLLTGVVVDSGDGVTHICPVYEGFSLPHLTRRLDIAGRDITRYLIKLLLLRGYAFNHSADFETVRMIKEKLCYVGYNIEQEQKLALETTVLVESYTLPDGRIIKVGGERFEAPEALFQPHLINVEGVGVAELLFNTIQAADIDTRSEFYKHIVLSGGSTMYPGLPSRLERELKQLYLERVLKGDVEKLSKFKIRIEDPPRRKHMVFLGGAVLADIMKDKDNFWMTRQEYQEKGVRVLEKLGVTVR

SEQ ID NO: 6431 - protein, 418 aa, Homo sapiens
  Payload ID: 1390;
  Gene Symbol: ACTR3;
  Gene Name: ARP3 actin-related prt 3 homolog (yeast);
  Uniprot ID:  P61158;
  ENSP ID: ENSP00000263238
MAGRLPACVVDCGTGYTKLGYAGNTEPQFIIPSCIAIKESAKVGDQAQRRVMKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 6432 - protein, 41 aa, Homo sapiens
  Payload ID: 1390;
  Gene Symbol: ACTR3;
  Gene Name: ARP3 actin-related prt 3 homolog (yeast);
  ENSP ID: ENSP00000394213
MAGRLPACVVDCGTGYTKLGYAGNTEPQFIIPSLANPPWYS

SEQ ID NO: 6433 - protein, 84 aa, Homo sapiens
  Payload ID: 1390;
  Gene Symbol: ACTR3;
  Gene Name: ARP3 actin-related prt 3 homolog (yeast);
  ENSP ID: ENSP00000403125
MKGVDDLDFFIGDEAIEKPTYATKWPIRHGIVEDWDLMERFMEQVIFKYLRAEPEDHYFLLTEPPLNTPENREYTAEIMFESFN

SEQ ID NO: 6434 - protein, 34 aa, Homo sapiens
  Payload ID: 1390;
  Gene Symbol: ACTR3;
  Gene Name: ARP3 actin-related prt 3 homolog (yeast);
  ENSP ID: ENSP00000407912
MAGRLPACVVDCGTGYTKLGYAGNTEPQFIIPSY

SEQ ID NO: 6435 - protein, 367 aa, Homo sapiens
  Payload ID: 1390;
  Gene Symbol: ACTR3;
  Gene Name: ARP3 actin-related prt 3 homolog (yeast);
  ENSP ID: ENSP00000444987
MKGVDDLDFFIGDEAIEKPTYATKWPIRHGIVEDWDLMERFMEQVIFKYLRAEPEDHYFLLTEPPLNTPENREYTAEIMFESFNVPGLYIAVQAVLALAASWTSRQVGERTLTGTVIDSGDGVTHVIPVAEGYVIGSCIKHIPIAGRDITYFIQQLLRDREVGIPPEQSLETAKAVKERYSYVCPDLVKEFNKYDTDGSKWIKQYTGINAISKKEFSIDVGYERFLGPEIFFHPEFANPDFTQPISEVVDEVIQNCPIDVRRPLYKNIVLSGGSTMFRDFGRRLQRDLKRTVDARLKLSEELSGGRLKPKPIDVQVITHHMQRYAVWFGGSMLASTPEFYQVCHTKKDYEEIGPSICRHNPVFGVMS

SEQ ID NO: 6436 - protein, 418 aa, Homo sapiens
  Payload ID: 1391;
  Gene Symbol: ACTR3B;
  Gene Name: ARP3 actin-related prt 3 homolog B (yeast);
  Uniprot ID:  Q9P1U1;
  ENSP ID: ENSP00000256001
MAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 6437 - protein, 348 aa, Homo sapiens
  Payload ID: 1391;
  Gene Symbol: ACTR3B;
  Gene Name: ARP3 actin-related prt 3 homolog B (yeast);
  Uniprot ID:  Q9P1U1;
  ENSP ID: ENSP00000367007
MAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKPEFFQVCHTKKDYEEYGPSICRHNPVFGVMS

SEQ ID NO: 6438 - protein, 330 aa, Homo sapiens
  Payload ID: 1391;
  Gene Symbol: ACTR3B;
  Gene Name: ARP3 actin-related prt 3 homolog B (yeast);
  Uniprot ID:  Q9P1U1;
  ENSP ID: ENSP00000380452
MERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 6439 - protein, 210 aa, Homo sapiens
  Payload ID: 1392;
  Gene Symbol: ACTR3C;
  Gene Name: ARP3 actin-related prt 3 homolog C (yeast);
  Uniprot ID:  Q9C0K3;
  ENSP ID: ENSP00000252071
MFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPQKWIKQYTGINAINQKKFVIDVGYERFLGPEIFFHPEFANPDSMESISDVVDEVIQNCPIDVRRPLYKMEQIPLSYPQGHGFHPLSPPFH

SEQ ID NO: 6440 - protein, 208 aa, Homo sapiens
  Payload ID: 1392;
  Gene Symbol: ACTR3C;
  Gene Name: ARP3 actin-related prt 3 homolog C (yeast);
  ENSP ID: ENSP00000417426
SPRLPEGWSRQPAEPLAKLGSPAQLRTAEPAPPRQTEPPLNTPENREYLAEGYVIGSCIKHIPIAGRDITYFIQQLLREREVGIPPEQSLETAKAIKEKYCYICPDIVKEFAKYDVDPQKWIKQYTGINAINQKKFVIDVGYERFLGPEIFFHPEFANPDSMESISDVVDEVIQNCPIDVRRPLYKMEQIPLSYPQGHGFHPLSPPFH

SEQ ID NO: 6441 - protein, 51 aa, Homo sapiens
  Payload ID: 1392;
  Gene Symbol: ACTR3C;
  Gene Name: ARP3 actin-related prt 3 homolog C (yeast);
  ENSP ID: ENSP00000417997
MFESFNVPGLYIAVQAVLALAASWTSRQVGERTLTGIVIDSGDGVTHVIPV

SEQ ID NO: 6442 - protein, 222 aa, Homo sapiens
  Payload ID: 1392;
  Gene Symbol: ACTR3C;
  Gene Name: ARP3 actin-related prt 3 homolog C (yeast);
  ENSP ID: ENSP00000418635
MGKGWLFRKILASPSVFRREGTAGPAGGPPGPARAPTAAPFPEPRRPSPRLPEGWSRQPAEPLAKLGSPAQLRTAEPAPPRQTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPQKW

SEQ ID NO: 6443 - protein, 189 aa, Homo sapiens
  Payload ID: 1392;
  Gene Symbol: ACTR3C;
  Gene Name: ARP3 actin-related prt 3 homolog C (yeast);
  ENSP ID: ENSP00000440990
MFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPQKWIKQYTGINAINQKKFVIDVGYERFLGPEIFFHPEFANPDSMESISDVVDEVIQNCPIDVRRPLYKV

SEQ ID NO: 6444 - protein, 24 aa, Homo sapiens
  Payload ID: 1392;
  Gene Symbol: ACTR3C;
  Gene Name: ARP3 actin-related prt 3 homolog C (yeast);
  ENSP ID: ENSP00000481447
FQMEQIPLSYPQGHGFHPLSPPFH

SEQ ID NO: 6445 - protein, 607 aa, Homo sapiens
  Payload ID: 1393;
  Gene Symbol: ACTR5;
  Gene Name: ARP5 actin-related prt 5 homolog (yeast);
  Uniprot ID:  Q9H9F9;
  ENSP ID: ENSP00000243903
MAANVFPFRDARAAPDPVLEAGPVAHGPLPVPLVLDNGSFQVRAGWACPGQDPGPEPRLQFRAVCARGRGGARGASGPQVGNALGSLEPLRWMLRSPFDRNVPVNLELQELLLDYSFQHLGVSSQGCVDHPIVLTEAVCNPLYSRQMMSELLFECYGIPKVAYGIDSLFSFYHNKPKNSMCSGLIISSGYQCTHVLPILEGRLDAKNCKRINLGGSQAAGYLQRLLQLKYPGHLAAITLSRMEEILHEHSYIAEDYVEELHKWRCPDYYENNVHKMQLPFSSKLLGSTLTSEEKQERRQQQLRRLQELNARRREEKLQLDQERLDRLLYVQELLEDGQMDQFHKALIELNMDSPEELQSYIQKLSIAVEQAKQKILQAEVNLEVDVVDSKPETPDLEQLEPSLEDVESMNDFDPLFSEETPGVEKPVTTVQPVFNLAAYHQLFVGTERIRAPEIIFQPSLIGEEQAGIAETLQYILDRYPKDIQEMLVQNVFLTGGNTMYPGMKARMEKELLEMRPFRSSFQVQLASNPVLDAWYGARDWALNHLDDNEVWITRKEYEEKGGEYLKEHCASNIYVPIRLPKQASRSSDAQASSKGSAAGGGGAGEQA

SEQ ID NO: 6446 - protein, 396 aa, Homo sapiens
  Payload ID: 1394;
  Gene Symbol: ACTR6;
  Gene Name: ARP6 actin-related prt 6 homolog (yeast);
  Uniprot ID:  Q9GZN1;
  ENSP ID: ENSP00000188312
MTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEEMQPHFFKNIVLTGGNSLFPGFRDRVYSEVRCLTPTDYDVSVVLPENPITYAWEGGKLISENDDFEDMVVTREDYEENGHSVCEEKFDI

SEQ ID NO: 6447 - protein, 376 aa, Homo sapiens
  Payload ID: 1394;
  Gene Symbol: ACTR6;
  Gene Name: ARP6 actin-related prt 6 homolog (yeast);
  ENSP ID: ENSP00000447237
MTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEGFRDRVYSEVRCLTPTDYDVSVVLPENPITYAWEGGKLISENDDFEDMVVTREDYEENGHSVCEEKFDI

SEQ ID NO: 6448 - protein, 144 aa, Homo sapiens
  Payload ID: 1394;
  Gene Symbol: ACTR6;
  Gene Name: ARP6 actin-related prt 6 homolog (yeast);
  ENSP ID: ENSP00000447565
MTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNGSCSVAQARVWWHKHGSL

SEQ ID NO: 6449 - protein, 127 aa, Homo sapiens
  Payload ID: 1394;
  Gene Symbol: ACTR6;
  Gene Name: ARP6 actin-related prt 6 homolog (yeast);
  ENSP ID: ENSP00000447641
MTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNG

SEQ ID NO: 6450 - protein, 294 aa, Homo sapiens
  Payload ID: 1394;
  Gene Symbol: ACTR6;
  Gene Name: ARP6 actin-related prt 6 homolog (yeast);
  ENSP ID: ENSP00000448356
MYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEGFRDRVYSEVRCLTPTDYDVSVVLPENPITYAWEGGKLISENDDFEDMVVTREDYEENGHSVCEEKFDI

SEQ ID NO: 6451 - protein, 88 aa, Homo sapiens
  Payload ID: 1394;
  Gene Symbol: ACTR6;
  Gene Name: ARP6 actin-related prt 6 homolog (yeast);
  ENSP ID: ENSP00000448447
MTTLVLDNGAYNAKIGYSHENVSVIPNCQFRSKTARLKTFTANQIDEIKDPSGLFYILPFQKGYLVNWDVQRQVWDYLFGKEMYQVTN

SEQ ID NO: 6452 - protein, 192 aa, Homo sapiens
  Payload ID: 1394;
  Gene Symbol: ACTR6;
  Gene Name: ARP6 actin-related prt 6 homolog (yeast);
  ENSP ID: ENSP00000448508
MYQGPSRVLKEAPGAEAYGYECLGGLHRTSTGCWGVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLL

SEQ ID NO: 6453 - protein, 314 aa, Homo sapiens
  Payload ID: 1394;
  Gene Symbol: ACTR6;
  Gene Name: ARP6 actin-related prt 6 homolog (yeast);
  ENSP ID: ENSP00000448669
MYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEMVLSGKYKSGEQILRLANERFAVPEILFNPSDIGIQEMGIPEAIVYSIQNLPEEMQPHFFKNIVLTGGNSLFPGFRDRVYSEVRCLTPTDYDVSVVLPENPITYAWEGGKLISENDDFEDMVVTREDYEENGHSVCEEKFDI

SEQ ID NO: 6454 - protein, 88 aa, Homo sapiens; identical to SEQ ID NO: 6451
  Payload ID: 1394;
  Gene Symbol: ACTR6;
  Gene Name: ARP6 actin-related prt 6 homolog (yeast);
  ENSP ID: ENSP00000450330

SEQ ID NO: 6455 - protein, 624 aa, Homo sapiens
  Payload ID: 1395;
  Gene Symbol: ACTR8;
  Gene Name: ARP8 actin-related prt 8 homolog (yeast);
  Uniprot ID:  Q9H981;
  ENSP ID: ENSP00000336842
MTQAEKGDTENGKEKGGEKEKEQRGVKRPIVPALVPESLQEQIQSNFIIVIHPGSTTLRIGRATDTLPASIPHVIARRHKQQGQPLYKDSWLLREGLNKPESNEQRQNGLKMVDQAIWSKKMSNGTRRIPVSPEQARSYNKQMRPAILDHCSGNKWTNTSHHPEYLVGEEALYVNPLDCYNIHWPIRRGQLNIHPGPGGSLTAVLADIEVIWSHAIQKYLEIPLKDLKYYRCILLIPDIYNKQHVKELVNMILMKMGFSGIVVHQESVCATYGSGLSSTCIVDVGDQKTSVCCVEDGVSHRNTRLCLAYGGSDVSRCFYWLMQRAGFPYRECQLTNKMDCLLLQHLKETFCHLDQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCSSDDTKKKMYSSILVVGGGLMFHKAQEFLQHRILNKMPPSFRRIIENVDVITRPKDMDPRLIAWKGGAVLACLDTTQELWIYQREWQRFGVRMLRERAAFVW

SEQ ID NO: 6456 - protein, 378 aa, Homo sapiens
  Payload ID: 1395;
  Gene Symbol: ACTR8;
  Gene Name: ARP8 actin-related prt 8 homolog (yeast);
  ENSP ID: ENSP00000417230
  MOD_RES (1)..(1): Any amino acid
XAVLADIEVIWSHAIQKYLEIPLKDLKYYRCILLIPDIYNKQHVKELVNMILMKMGFSGIVVHQESVCATYGSGLSSTCIVDVGDQKTSVCCVEDGVSHRNTRIFSWNQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCSSDDTKKKMYSSILVVGGGLMFHKAQEFLQHRILNKMPPSFRRIIENVDVITRPKDMDPRLIAWKGGAVLACLDTTQELWIYQREWQRFGVRMLRERAAFVW

SEQ ID NO: 6457 - protein, 102 aa, Homo sapiens
  Payload ID: 1395;
  Gene Symbol: ACTR8;
  Gene Name: ARP8 actin-related prt 8 homolog (yeast);
  ENSP ID: ENSP00000417781
MVDQAIWSKKMSNGTRRIPVSPEQARSYNKQMRPAILDHCSGNKWTNTSHHPEYLVGEEALYVNPLDCYNIHWPIRRGQLNIHPGPGGSLTAVLADIEVIWS

SEQ ID NO: 6458 - protein, 513 aa, Homo sapiens
  Payload ID: 1395;
  Gene Symbol: ACTR8;
  Gene Name: ARP8 actin-related prt 8 homolog (yeast);
  Uniprot ID:  Q9H981;
  ENSP ID: ENSP00000419429
MVDQAIWSKKMSNGTRRIPVSPEQARSYNKQMRPAILDHCSGNKWTNTSHHPEYLVGEEALYVNPLDCYNIHWPIRRGQLNIHPGPGGSLTAVLADIEVIWSHAIQKYLEIPLKDLKYYRCILLIPDIYNKQHVKELVNMILMKMGFSGIVVHQESVCATYGSGLSSTCIVDVGDQKTSVCCVEDGVSHRNTRLCLAYGGSDVSRCFYWLMQRAGFPYRECQLTNKMDCLLLQHLKETFCHLDQDISGLQDHEFQIRHPDSPALLYQFRLGDEKLQAPMALFYPATFGIVGQKMTTLQHRSQGDPEDPHDEHYLLATQSKQEQSAKATADRKSASKPIGFEGDLRGQSSDLPERLHSQEVDLGSAQGDGLMAGNDSEEALTALMSRKTAISLFEGKALGLDKAILHSIDCCSSDDTKKKMYSSILVVGGGLMFHKAQEFLQHRILNKMPPSFRRIIENVDVITRPKDMDPRLIAWKGGAVLACLDTTQELWIYQREWQRFGVRMLRERAAFVW

SEQ ID NO: 6459 - protein, 625 aa, Homo sapiens
  Payload ID: 1396;
  Gene Symbol: ARPC4-TTLL3;
  Gene Name: ARPC4-TTLL3 readthrough;
  ENSP ID: ENSP00000380427
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEQKKIFTIQGCYPVIRCLLRRRGWVEKKMVHRSGPTLLPPQKDLDSSAMGDSDTTEDEDEDEDEEFQPSQLFDFDDLLKFDDLDGTHALMVGLCLNLRNLPWFDEVDANSFFPRCYCLGAEDDKKAFIGDKQPKKQEKNPVLVSPEFVDEALCACEEYLSNLAHMDIDKDLEAPLYLTPEGWSLFLQRYYQVVHEGAELRHLDTQVQRCEDILQQLQAVVPQIDMEGDRNIWIVKPGAKSRGRGIMCMDHLEEMLKLVNGNPVVMKDGKWVVQKYIERPLLIFGTKFDLRQWFLVTDWNPLTVWFYRDSYIRFSTQPFSLKNLDNSVHLCNNSIQKHLENSCHRHPLLPPDNMWSSQRFQAHLQEMGAPNAWSTIIVPGMKDAVIHALQTSQDTVQCRKASFELYGADFVFGEDFQPWLIEINASPTMAPSTAVTARLCAGVQADTLRVVIDRMLDRNCDTGAFELIYKQPVTTSPASTPRPSCLLPMYSDTRARSSDDSTASWWALRPCRPQARP

SEQ ID NO: 6460 - protein, 167 aa, Homo sapiens
  Payload ID: 1396;
  Gene Symbol: ARPC4-TTLL3;
  Gene Name: ARPC4-TTLL3 readthrough;
  ENSP ID: ENSP00000393764
  MOD_RES (1)..(1): Any amino acid
XTATLRPYLSAVRATLQAALCLENFSSQVVERHNKPEVEVRSSKELLLQPVTISRNEKEKVLIEGSINSVRVSIAVKQGYDISFLITNFHTEQMYKHKLVDFVIHFMEEIDKEISEMKLSVNARARIVAEEFLKNQKKIFTIQGCYPVIRCLLRRRGWVEKKMVHRS

SEQ ID NO: 6461 - protein, 47 aa, Homo sapiens
  Payload ID: 1396;
  Gene Symbol: ARPC4-TTLL3;
  Gene Name: ARPC4-TTLL3 readthrough;
  ENSP ID: ENSP00000402163
MTATLRPYLSAVRATLQAALCLENFSSQVVERHNKPEVEVRGMISAF

SEQ ID NO: 6462 - protein, 181 aa, Homo sapiens
  Payload ID: 1396;
  Gene Symbol: ARPC4-TTLL3;
  Gene Name: ARPC4-TTLL3 readthrough;
  ENSP ID: ENSP00000412284
MTATLRPYLSAVRATLQAALCLENFSSQVVERHNKPEVEVRSSKELLLQPVTISRNEKEKVLIEGSINSVRVSIAVKQADEIEKILCHKFMRFMMMRAENFFILRRKPVEGYDISFLITNFHTEQMYKHKLVDFVIHFMEEIDKEISEMKLSVNARARIVAEEFLKNVSRSSGEDPPRRLT

SEQ ID NO: 6463 - protein, 388 aa, Homo sapiens
  Payload ID: 1397;
  Gene Symbol: ARR3;
  Gene Name: arrestin 3, retinal (X-arrestin);
  Uniprot ID:  P36575;
  ENSP ID: ENSP00000311538
MSKVFKKTSSNGKLSIYLGKRDFVDHVDTVEPIDGVVLVDPEYLKCRKLFVMLTCAFRYGRDDLEVIGLTFRKDLYVQTLQVVPAESSSPQGPLTVLQERLLHKLGDNAYPFTLQMVTNLPCSVTLQPGPEDAGKPCGIDFEVKSFCAENPEETVSKRDYVRLVVRKVQFAPPEAGPGPSAQTIRRFLLSAQPLQLQAWMDREVHYHGEPISVNVSINNCTNKVIKKIKISVDQITDVVLYSLDKYTKTVFIQEFTETVAANSSFSQSFAVTPILAASCQKRGLALDGKLKHEDTNLASSTIIRPGMDKELLGILVSYKVRVNLMVSCGGILGDLTASDVGVELPLVLIHPKPSHEAASSEDIVIEEFTRKGEEESQKAVEAEGDEGS

SEQ ID NO: 6464 - protein, 359 aa, Homo sapiens
  Payload ID: 1397;
  Gene Symbol: ARR3;
  Gene Name: arrestin 3, retinal (X-arrestin);
  Uniprot ID:  P36575;
  ENSP ID: ENSP00000363619
MSKVFKKTSSNGKLSIYLGKRDFVDHVDTVEPIDGVVLVDPEYLKCRKLFVMLTCAFRYGRDDLEVIGLTFRKDLYVQTLQVVPAESSSPQGPLTVLQERLLHKLGDNAYPFTLQMVTNLPCSVTLQPGPEDAGKPCGIDFEVKSFCAENPEETVSKRDYVRLVVRKVQFAPPEAGPGPSAQTIRRFLLSAQPLQLQAWMDREVHYHGEPISVNVSINNCTNKVIKKIKISVDQITDVVLYSLDKYTKTVFIQEFTETVAANSSFSQSFAVTPILAASCQKRGLALDGKLKHEDTNLASSTIIRPGMDKELLGILVSYKVRVNLMVSCGGILGDLTASDVGVELPLVLIHPKPSHEAAR

SEQ ID NO: 6465 - protein, 97 aa, Homo sapiens
  Payload ID: 1397;
  Gene Symbol: ARR3;
  Gene Name: arrestin 3, retinal (X-arrestin);
  ENSP ID: ENSP00000425505
MLTCAFRYGRDDLEVIGLTFRKDLYVQTLQVVPAESSSPQGPLTVLQERLLHKLGDNAYPFTLQMVTNLPCSVTLQPGPEDAGKPCGIDFEVKSFCA

SEQ ID NO: 6466 - protein, 388 aa, Homo sapiens [sequence omitted]

SEQ ID NO: 6467 - protein, 433 aa, Homo sapiens
  Payload ID: 1398;
  Gene Symbol: ARRDC1;
  Gene Name: arrestin domain containing 1;
  Uniprot ID:  Q8N5I2;
  ENSP ID: ENSP00000360475
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYEAPPSYEQSCGGVEPSLTPES

SEQ ID NO: 6468 - protein, 177 aa, Homo sapiens
  Payload ID: 1398;
  Gene Symbol: ARRDC1;
  Gene Name: arrestin domain containing 1;
  ENSP ID: ENSP00000406247
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEGSSLRTPAKPLPGPPPKQPNVASATKKFSYKL

SEQ ID NO: 6469 - protein, 271 aa, Homo sapiens
  Payload ID: 1398;
  Gene Symbol: ARRDC1;
  Gene Name: arrestin domain containing 1;
  ENSP ID: ENSP00000406833
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLV

SEQ ID NO: 6470 - protein, 123 aa, Homo sapiens
  Payload ID: 1398;
  Gene Symbol: ARRDC1;
  Gene Name: arrestin domain containing 1;
  ENSP ID: ENSP00000435996
MGRVQLFEISLSHGRVVYSPGEPLAGTVRVRLGAPLPFRAIRVTCIGSCGVSNKANDTAWVVEEGYFNSSLSLADKGKFGSQFPSGDPWGQPLEWGLSVLSSPFPRSASWIWHWPILSQGCGP

SEQ ID NO: 6471 - protein, 407 aa, Homo sapiens
  Payload ID: 1399;
  Gene Symbol: ARRDC2;
  Gene Name: arrestin domain containing 2;
  Uniprot ID:  Q8TBH0;
  ENSP ID: ENSP00000222250
MLFDKVKAFSVQLDGATAGVEPVFSGGQAVAGRVLLELSSAARVGALRLRARGRAHVHWTESRSAGSSTAYTQSYSERVEVVSHRATLLAPDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVCVDIPGTSKLLLELPLVIGTIPLHPFGSRSSSVGSHASFLLDWRLGALPERPEAPPEYSEVVADTEEAALGQSPFPLPQDPDMSLEGPFFAYIQEFRYRPPPLYSEEDPNPLLGDMRPRCMTC

SEQ ID NO: 6472 - protein, 402 aa, Homo sapiens
  Payload ID: 1399;
  Gene Symbol: ARRDC2;
  Gene Name: arrestin domain containing 2;
  Uniprot ID:  Q8TBH0;
  ENSP ID: ENSP00000368977
MRSGGVRSFALELARGPGGAYRGGERLCGRVLLEAAAPLRVRALEVKARGGAATHWLEGRSVGVNAVSSDYAAAETYLRRRQLLLRDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDYALKVCVDIPGTSKLLLELPLVIGTIPLHPFGSRSSSVGSHASFLLDWRLGALPERPEAPPEYSEVVADTEEAALGQSPFPLPQDPDMSLEGPFFAYIQEFRYRPPPLYSEEDPNPLLGDMRPRCMTC

SEQ ID NO: 6473 - protein, 6 aa, Homo sapiens
  Payload ID: 1399;
  Gene Symbol: ARRDC2;
  Gene Name: arrestin domain containing 2;
  ENSP ID: ENSP00000476804
MARGAR

SEQ ID NO: 6474 - protein, 322 aa, Homo sapiens
  Payload ID: 1399;
  Gene Symbol: ARRDC2;
  Gene Name: arrestin domain containing 2;
  ENSP ID: ENSP00000477100
MLFDKVKAFSVQLDGATAGVEPVFSGGQAVAGRVLLELSSAARVGALRLRARGRAHVHWTESRSAGSSTAYTQSYSERVEVVSHRATLLAPGTDGGPLLQHQLCASHHLDGGTSVSPGTPAQPLSRLLFLLPADTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRALWQGRALRIPPVGPSILHCRVLHVDY

SEQ ID NO: 6475 - protein, 414 aa, Homo sapiens
  Payload ID: 1400;
  Gene Symbol: ARRDC3;
  Gene Name: arrestin domain containing 3;
  Uniprot ID:  Q96B67;
  ENSP ID: ENSP00000265138
MVLGKVKSLTISFDCLNDSNVPVYSSGDTVSGRVNLEVTGEIRVKSLKIHARGHAKVRWTESRNAGSNTAYTQNYTEEVEYFNHKDILIGHERDDDNSEEGFHTIHSGRHEYAFSFELPQTPLATSFEGRHGSVRYWVKAELHRPWLLPVKLKKEFTVFEHIDINTPSLLSPQAGTKEKTLCCWFCTSGPISLSAKIERKGYTPGESIQIFAEIENCSSRMVVPKAAIYQTQAFYAKGKMKEVKQLVANLRGESLSSGKTETWNGKLLKIPPVSPSILDCSIIRVEYSLMVYVDIPGAMDLFLNLPLVIGTIPLHPFGSRTSSVSSQCSMNMNWLSLSLPERPEAPPSYAEVVTEEQRRNNLAPVSACDDFERALQGPLFAYIQEFRFLPPPLYSEIDPNPDQSADDRPSCPSR

SEQ ID NO: 6476 - protein, 418 aa, Homo sapiens
  Payload ID: 1401;
  Gene Symbol: ARRDC4;
  Gene Name: arrestin domain containing 4;
  Uniprot ID:  Q8NCT1;
  ENSP ID: ENSP00000268042
MGGEAGCAAAVGAEGRVKSLGLVFEDERKGCYSSGETVAGHVLLEASEPVALRALRLEAQGRATAAWGPSTCPRASASTAALAVFSEVEYLNVRLSLREPPAGEGIILLQPGKHEFPFRFQLPSEPLVTSFTGKYGSIQYCVRAVLERPKVPDQSVKRELQVVSHVDVNTPALLTPVLKTQEKMVGCWFFTSGPVSLSAKIERKGYCNGEAIPIYAEIENCSSRLIVPKAAIFQTQTYLASGKTKTIRHMVANVRGNHIASGSTDTWNGKTLKIPPVTPSILDCCIIRVDYSLAVYIHIPGAKKLMLELPLVIGTIPYNGFGSRNSSIASQFSMDMSWLTLTLPEQPEAPPNYADVVSEEEFSRHIPPYPQPPNCEGEVCCPVFACIQEFRFQPPPLYSEVDPHPSDVEESQPVSFIL

SEQ ID NO: 6477 - protein, 342 aa, Homo sapiens
  Payload ID: 1402;
  Gene Symbol: ARRDC5;
  Gene Name: arrestin domain containing 5;
  Uniprot ID:  A6NEK1;
  ENSP ID: ENSP00000371200
MGDREECLSTPQPPMSVVKSIELVLPEDRIYLAGSSIKGQVILTLNSTLVDPIVKVELVGRGYVEWSEEAGASCDYSRNVICNNKADYVHKTKTFPVEDNWLSAGSHTFDFHFNLPPRLPSTFTSKFGHVFYFVQASCMGREHILAKKRMYLLVQGTSTFHKETPFQNPLFVEAEEKVSYNCCRQGTVCLQIQMERNTFTPGEKVVFTTEINNQTSKCIKTVVFALYAHIQYEGFTPSAERRSRLDSSELLRQEANTPVTRFNTTKVVSTFNLPLLLSVSSSTQDGEIMHTRYELVTTVHLPWSLTSLKAKVPIIITSASVDSAICQLSEDGVLPVNPDHQN

SEQ ID NO: 6478 - protein, 410 aa, Homo sapiens
  Payload ID: 1403;
  Gene Symbol: ARRB1;
  Gene Name: arrestin, beta 1;
  Uniprot ID:  P49407;
  ENSP ID: ENSP00000353124
MGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVPENETPVDTNLIELDTNDDDIVFEDFARQRLKGMKDDKEEEEDGTGSPQLNNR

SEQ ID NO: 6479 - protein, 418 aa, Homo sapiens
  Payload ID: 1403;
  Gene Symbol: ARRB1;
  Gene Name: arrestin, beta 1;
  Uniprot ID:  P49407;
  ENSP ID: ENSP00000409581
MGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGLLGDLASSDVAVELPFTLMHPKPKEEPPHREVPENETPVDTNLIELDTNDDDIVFEDFARQRLKGMKDDKEEEEDGTGSPQLNNR

SEQ ID NO: 6480 - protein, 72 aa, Homo sapiens
  Payload ID: 1403;
  Gene Symbol: ARRB1;
  Gene Name: arrestin, beta 1;
  ENSP ID: ENSP00000433137
  MOD_RES (1)..(1): Any amino acid
XVCLPLPCRCSGETTPTPGPVPSAECSRRPVQMESSPSTWESGTLWTTSTSWTLWMVWSWWILSISKSGESM

SEQ ID NO: 6481 - protein, 257 aa, Homo sapiens
  Payload ID: 1403;
  Gene Symbol: ARRB1;
  Gene Name: arrestin, beta 1;
  ENSP ID: ENSP00000433171
MGVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTV

SEQ ID NO: 6482 - protein, 69 aa, Homo sapiens
  Payload ID: 1403;
  Gene Symbol: ARRB1;
  Gene Name: arrestin, beta 1;
  ENSP ID: ENSP00000434196
  MOD_RES (1)..(1): Any amino acid
XGGRRRERPAAATARDGRGEAMEGDLQRERLSSPSTWESGTLWTTSTSWTLWMVWSWWILSISKSGESM

SEQ ID NO: 6483 - protein, 59 aa, Homo sapiens
  Payload ID: 1403;
  Gene Symbol: ARRB1;
  Gene Name: arrestin, beta 1;
  ENSP ID: ENSP00000436352
SHCKRWERRGHGRRLAAGEAESVQEGQSKWKAHRLPGKAGLCGPHRPRGPCGWCGPGGS

SEQ ID NO: 6484 - protein, 195 aa, Homo sapiens
  Payload ID: 1403;
  Gene Symbol: ARRB1;
  Gene Name: arrestin, beta 1;
  ENSP ID: ENSP00000436530
  MOD_RES (1)..(1): Any amino acid
XRPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVMTTLYLRTLLARD

SEQ ID NO: 6485 - protein, 409 aa, Homo sapiens
  Payload ID: 1404;
  Gene Symbol: ARRB2;
  Gene Name: arrestin, beta 2;
  Uniprot ID:  P32121;
  ENSP ID: ENSP00000269260
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 6486 - protein, 406 aa, Homo sapiens
  Payload ID: 1404;
  Gene Symbol: ARRB2;
  Gene Name: arrestin, beta 2;
  Uniprot ID:  P32121;
  ENSP ID: ENSP00000341895
MGEKPGTRVFKKSSPNCKLTVYLGKRDFVDHLDKVDPVVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAPTPTPPLPVPPAAPETDVPVDTNLIEFDTNYATDDDIVFEDFARLRLKGMKDDDYDDQLC

SEQ ID NO: 6487 - protein, 394 aa, Homo sapiens
  Payload ID: 1404;
  Gene Symbol: ARRB2;
  Gene Name: arrestin, beta 2;
  Uniprot ID:  P32121;
  ENSP ID: ENSP00000370898
MGEKPGTRVFKKSSPNCKLTVYLGKRDFVDHLDKVDPVVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 6488 - protein, 430 aa, Homo sapiens
  Payload ID: 1404;
  Gene Symbol: ARRB2;
  Gene Name: arrestin, beta 2;
  Uniprot ID:  P32121;
  ENSP ID: ENSP00000403701
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTVRMPLPSEGQGAGAGTVSGVGIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 6489 - protein, 64 aa, Homo sapiens
  Payload ID: 1404;
  Gene Symbol: ARRB2;
  Gene Name: arrestin, beta 2;
  ENSP ID: ENSP00000458371
MGEKPGTRVFKKSSPNCKLTVYLGKRDFVDHLDKVDPVDTPESSMLRHTAARPRGYRKGLRRRL

SEQ ID NO: 6490 - protein, 74 aa, Homo sapiens
  Payload ID: 1404;
  Gene Symbol: ARRB2;
  Gene Name: arrestin, beta 2;
  ENSP ID: ENSP00000458946
MGEKPGTRVFKKSSPNCKPLAAEAAQPEPATGLGGAGLGPQARPQRRRPKASHVPVALLGANPSSPCTWASGTS

SEQ ID NO: 6491 - protein, 217 aa, Homo sapiens
  Payload ID: 1404;
  Gene Symbol: ARRB2;
  Gene Name: arrestin, beta 2;
  ENSP ID: ENSP00000460607
MSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASSTIVKEGANKEVLGILVSYRVKVKLVVSRGGDVSVELPFVLMHPKPHDHIPLPRPQSAAPETDVPVDTNLIEFDTNYATDDDIVFEDFARLRLKGMKDDDYDDQLC

SEQ ID NO: 6492 - protein, 196 aa, Homo sapiens
  Payload ID: 1404;
  Gene Symbol: ARRB2;
  Gene Name: arrestin, beta 2;
  ENSP ID: ENSP00000460879
GGETRDQLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKE

SEQ ID NO: 6493 - protein, 217 aa, Homo sapiens; identical to SEQ ID NO: 6491
  Payload ID: 1404;
  Gene Symbol: ARRB2;
  Gene Name: arrestin, beta 2;
  ENSP ID: ENSP00000465296

SEQ ID NO: 6494 - protein, 113 aa, Homo sapiens
  Payload ID: 1404;
  Gene Symbol: ARRB2;
  Gene Name: arrestin, beta 2;
  ENSP ID: ENSP00000465877
MSDRSLHLEASLDKELYYHGEPLNVNVHVTNNSTKTVKKIKVSVRQYADICLFSTAQYKCPVAQLEQDDQVSPSSTFCKVYTITPLLSDNREKRGLALDGKLKHEDTNLASST

SEQ ID NO: 6495 - protein, 217 aa, Homo sapiens; identical to SEQ ID NO: 6491
  Payload ID: 1404;
  Gene Symbol: ARRB2;
  Gene Name: arrestin, beta 2;
  ENSP ID: ENSP00000466344

SEQ ID NO: 6496 - protein, 330 aa, Homo sapiens
  Payload ID: 1404;
  Gene Symbol: ARRB2;
  Gene Name: arrestin, beta 2;
  ENSP ID: ENSP00000466857
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVAQLEQDDQREGGCQQGGAGNPGVLQGQGEAGGVSRRGCLCGAAFCSYAPQAPRPHPPPQTPVSRSGDRCPCGHQPH

SEQ ID NO: 6497 - protein, 348 aa, Homo sapiens
  Payload ID: 1405;
  Gene Symbol: ASNA1;
  Gene Name: arsA arsenite transporter, ATP-binding, homolog 1 (bacterial);
  Uniprot ID:  O43681;
  ENSP ID: ENSP00000349887
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQMCNMLGLGDMNADQLASKLEETLPVIRSVSEQFKDPEQTTFICVCIAEFLSLYETERLIQELAKCKIDTHNIIVNQLVFPDPEKPCKMCEARHKIQAKYLDQMEDLYEDFHIVKLPLLPHEVRGADKVNTFSALLLEPYKPPSAQ

SEQ ID NO: 6498 - protein, 348 aa, Homo sapiens; identical to SEQ ID NO: 6497
  Payload ID: 1405;
  Gene Symbol: ASNA1;
  Gene Name: arsA arsenite transporter, ATP-binding, homolog 1 (bacterial);
  Uniprot ID:  O43681;
  ENSP ID: ENSP00000466379

SEQ ID NO: 6499 - protein, 200 aa, Homo sapiens
  Payload ID: 1405;
  Gene Symbol: ASNA1;
  Gene Name: arsA arsenite transporter, ATP-binding, homolog 1 (bacterial);
  ENSP ID: ENSP00000468450
MAAGVAGWGVEAEEFEDAPDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPF

SEQ ID NO: 6500 - protein, 331 aa, Homo sapiens
  Payload ID: 1405;
  Gene Symbol: ASNA1;
  Gene Name: arsA arsenite transporter, ATP-binding, homolog 1 (bacterial);
  ENSP ID: ENSP00000481254
MLDVEPLEPTLSNIIEQRSLKWIFVGGKGGVGKTTCSCSLAVQLSKGRESVLIISTDPAHNISDAFDQKFSKVPTKVKGYDNLFAMEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQMCNMLGLGDMNADQLASKLEETLPVIRSVSEQFKDPEQTTFICVCIAEFLSLYETERLIQELAKCKIDTHNIIVNQLVFPDPEKPCKMCEARHKIQAKYLDQMEDLYEDFHIVKLPLLPHEVRGADKVNTFSALLLEPYKPPSAQ

SEQ ID NO: 6501 - protein, 375 aa, Homo sapiens
  Payload ID: 1406;
  Gene Symbol: AS3MT;
  Gene Name: arsenite methyltransferase;
  Uniprot ID:  Q9HBK9;
  ENSP ID: ENSP00000358896
MAALRDAEIQKDVQTYYGQVLKRSADLQTNGCVTTARPVPKHIREALQNVHEEVALRYYGCGLVIPEHLENCWILDLGSGSGRDCYVLSQLVGEKGHVTGIDMTKGQVEVAEKYLDYHMEKYGFQASNVTFIHGYIEKLGEAGIKNESHDIVVSNCVINLVPDKQQVLQEAYRVLKHGGELYFSDVYTSLELPEEIRTHKVLWGECLGGALYWKELAVLAQKIGFCPPRLVTANLITIQNKELERVIGDCRFVSATFRLFKHSKTGPTKRCQVIYNGGITGHEKELMFDANFTFKEGEIVEVDEETAAILKNSRFAQDFLIRPIGEKLPTSGGCSALELKDIITDPFKLAEESDSMKSRCVPDAAGGCCGTKKSC

SEQ ID NO: 6502 - protein, 338 aa, Homo sapiens
  Payload ID: 1406;
  Gene Symbol: AS3MT;
  Gene Name: arsenite methyltransferase;
  ENSP ID: ENSP00000479361
MAALRDAEIQKDVQTYYGQVLKRSADLQTNGCVTTARPVPKHIREALQNVHEEVALRYYGCGLVIPEHLENCWILDLGSGSGRDCYVLSQLVGEKGHVTGIDMTKGQVEVAEKYLDYHMEKYGFQASNVTFIHGYIEKLGEAGIKNESHDIVVSNCVINLVPDKQQVLQEAYRVLKHGGELYFSDVYTSLELPEEIRTHKVLWGECLGGALYWKELAVLAQKIGFCPPRLVTANLITIQNKELERVIGDCRFVSATFRLFKHSKTGPTKRCQVIYNGGITGHEKELMFDANFTFKEGEIVEVDEETAAILKNSRFAQDFLIRPIGEKLPTSGAVLLWS

SEQ ID NO: 6503 - protein, 220 aa, Homo sapiens
  Payload ID: 1407;
  Gene Symbol: ARTN;
  Gene Name: artemin;
  Uniprot ID:  Q5T4W7;
  ENSP ID: ENSP00000361429
MELGLGGLSTLSHCPWPRQQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 6504 - protein, 220 aa, Homo sapiens; identical to SEQ ID NO: 6503
  Payload ID: 1407;
  Gene Symbol: ARTN;
  Gene Name: artemin;
  Uniprot ID:  Q5T4W7;
  ENSP ID: ENSP00000361434

SEQ ID NO: 6505 - protein, 228 aa, Homo sapiens
  Payload ID: 1407;
  Gene Symbol: ARTN;
  Gene Name: artemin;
  Uniprot ID:  Q5T4W7;
  ENSP ID: ENSP00000387435
MELGLGGLSTLSHCPWPRQQAPLGLSAQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 6506 - protein, 237 aa, Homo sapiens
  Payload ID: 1407;
  Gene Symbol: ARTN;
  Gene Name: artemin;
  Uniprot ID:  Q5T4W7;
  ENSP ID: ENSP00000391998
MPGLISARGQPLLEVLPPQAHLGALFLPEAPLGLSAQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 6507 - protein, 76 aa, Homo sapiens
  Payload ID: 1407;
  Gene Symbol: ARTN;
  Gene Name: artemin;
  ENSP ID: ENSP00000434071
MELGLGGLSTLSHCPWPRQQAPLGLSAQPALWPTLAALALLSSVAEASLGSAPRSPAPREGPPPVLASPAGHLPGR

SEQ ID NO: 6508 - protein, 66 aa, Homo sapiens
  Payload ID: 1407;
  Gene Symbol: ARTN;
  Gene Name: artemin;
  ENSP ID: ENSP00000434784
MELGLGGLSTLSHCPWPRQQPALWPTLAALALLSSVAEASLGSAPRSPAPREGPPPVLASPAGHLP

SEQ ID NO: 6509 - protein, 89 aa, Homo sapiens
  Payload ID: 1407;
  Gene Symbol: ARTN;
  Gene Name: artemin;
  ENSP ID: ENSP00000434856
MELGLGGLSTLSHCPWPRQQAPLGLSAQPALWPTLAALALLSSVAEASLGSAPRSPAPREGPPPVLASPAGHLPGGRTARWCSGRARRP

SEQ ID NO: 6510 - protein, 76 aa, Homo sapiens; identical to SEQ ID NO: 6507
  Payload ID: 1407;
  Gene Symbol: ARTN;
  Gene Name: artemin;
  ENSP ID: ENSP00000435140

SEQ ID NO: 6511 - protein, 66 aa, Homo sapiens; identical to SEQ ID NO: 6508
  Payload ID: 1407;
  Gene Symbol: ARTN;
  Gene Name: artemin;
  ENSP ID: ENSP00000435804

SEQ ID NO: 6512 - protein, 89 aa, Homo sapiens; identical to SEQ ID NO: 6509
  Payload ID: 1407;
  Gene Symbol: ARTN;
  Gene Name: artemin;
  ENSP ID: ENSP00000436149

SEQ ID NO: 6513 - protein, 228 aa, Homo sapiens; identical to SEQ ID NO: 6505
  Payload ID: 1407;
  Gene Symbol: ARTN;
  Gene Name: artemin;
  Uniprot ID:  Q5T4W7;
  ENSP ID: ENSP00000436727

SEQ ID NO: 6514 - protein, 271 aa, Homo sapiens
  Payload ID: 1408;
  Gene Symbol: ARV1;
  Gene Name: ARV1 homolog, fatty acid homeostasis modulator;
  Uniprot ID:  Q9H2C2;
  ENSP ID: ENSP00000312458
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 6515 - protein, 231 aa, Homo sapiens
  Payload ID: 1408;
  Gene Symbol: ARV1;
  Gene Name: ARV1 homolog, fatty acid homeostasis modulator;
  ENSP ID: ENSP00000355618
MGNGGRSGLQQGKGNVDGVAATPTAASASCQYRCIECNQEAKELYRDYNHGVLKITICIHGKLCIFCLLCEAYLRWWQLQDSNQNTAPDDLIRYAKEWDFYRMFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 6516 - protein, 291 aa, Homo sapiens
  Payload ID: 1408;
  Gene Symbol: ARV1;
  Gene Name: ARV1 homolog, fatty acid homeostasis modulator;
  ENSP ID: ENSP00000394547
  MOD_RES (1)..(1): Any amino acid
XNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALGWSAVAQSQLTAALNSWAQAILLPRPPQVAGTTEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 6517 - protein, 268 aa, Homo sapiens
  Payload ID: 1408;
  Gene Symbol: ARV1;
  Gene Name: ARV1 homolog, fatty acid homeostasis modulator;
  ENSP ID: ENSP00000416039
  MOD_RES (1)..(1): Any amino acid
XGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 6518 - protein, 122 aa, Homo sapiens
  Payload ID: 1408;
  Gene Symbol: ARV1;
  Gene Name: ARV1 homolog, fatty acid homeostasis modulator;
  ENSP ID: ENSP00000435420
  MOD_RES (1)..(1): Any amino acid
XQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 6519 - protein, 247 aa, Homo sapiens
  Payload ID: 1408;
  Gene Symbol: ARV1;
  Gene Name: ARV1 homolog, fatty acid homeostasis modulator;
  ENSP ID: ENSP00000436763
MGWQRLLLLPRPPASTGASNATRRPKSCTETITTKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 6520 - protein, 848 aa, Homo sapiens
  Payload ID: 1409;
  Gene Symbol: AHR;
  Gene Name: aryl hydrocarbon receptor;
  Uniprot ID:  P35869;
  ENSP ID: ENSP00000242057
MNSSSANITYASRKRRKPVQKTVKPIPAEGIKSNPSKRHRDRLNTELDRLASLLPFPQDVINKLDKLSVLRLSVSYLRAKSFFDVALKSSPTERNGGQDNCRAANFREGLNLQEGEFLLQALNGFVLVVTTDALVFYASSTIQDYLGFQQSDVIHQSVYELIHTEDRAEFQRQLHWALNPSQCTESGQGIEEATGLPQTVVCYNPDQIPPENSPLMERCFICRLRCLLDNSSGFLAMNFQGKLKYLHGQKKKGKDGSILPPQLALFAIATPLQPPSILEIRTKNFIFRTKHKLDFTPIGCDAKGRIVLGYTEAELCTRGSGYQFIHAADMLYCAESHIRMIKTGESGMIVFRLLTKNNRWTWVQSNARLLYKNGRPDYIIVTQRPLTDEEGTEHLRKRNTKLPFMFTTGEAVLYEATNPFPAIMDPLPLRTKNGTSGKDSATTSTLSKDSLNPSSLLAAMMQQDESIYLYPASSTSSTAPFENNFFNESMNECRNWQDNTAPMGNDTILKHEQIDQPQDVNSFAGGHPGLFQDSKNSDLYSIMKNLGIDFEDIRHMQNEKFFRNDFSGEVDFRDIDLTDEILTYVQDSLSKSPFIPSDYQQQQSLALNSSCMVQEHLHLEQQQQHHQKQVVVEPQQQLCQKMKHMQVNGMFENWNSNQFVPFNCPQQDPQQYNVFTDLHGISQEFPYKSEMDSMPYTQNFISCNQPVLPQHSKCTELDYPMGSFEPSPYPTTSSLEDFVTCLQLPENQKHGLNPQSAIITPQTCYAGAVSMYQCQPEPQHTHVGQMQYNPVLPGQQAFLNKFQNGVLNETYPAELNNINNTQTTTHLQPLHHPSEARPFPDLTSSGFL

SEQ ID NO: 6521 - protein, 848 aa, Homo sapiens; identical to SEQ ID NO: 6520
  Payload ID: 1409;
  Gene Symbol: AHR;
  Gene Name: aryl hydrocarbon receptor;
  Uniprot ID:  P35869;
  ENSP ID: ENSP00000436466

SEQ ID NO: 6522 - protein, 330 aa, Homo sapiens
  Payload ID: 1410;
  Gene Symbol: AIP;
  Gene Name: aryl hydrocarbon receptor interacting prt;
  Uniprot ID:  O00170;
  ENSP ID: ENSP00000279146
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKEQPGSPEWIQLDQQITPLLLNYCQCKLVVEEYYEVLDHCSSILNKYDDNVKAYFKRGKAHAAVWNAQEAQADFAKVLELDPALAPVVSRELRALEARIRQKDEEDKARFRGIFSH

SEQ ID NO: 6523 - protein, 232 aa, Homo sapiens
  Payload ID: 1410;
  Gene Symbol: AIP;
  Gene Name: aryl hydrocarbon receptor interacting prt;
  ENSP ID: ENSP00000434982
MADIIARLREDGIQKRVIQEGRGELPDFQDGTKATFHYRTLHSDDEGTVLDDSRARGKPMELIIGKKFKLPVWETIVCTMREGEIAQFLCDIKVESPGTYQQDPWAMTDEEKAKAVPLIHQEGNRLYREGHVKEAAAKYYDAIACLKNLQMKEQPGSPEWIQLDQQITPLLLNYCQCKLVVEEYYEVLDHCSSILNKYDDNVKAYFKRGKAHAAVWNAQEAQADFAKVLELD

SEQ ID NO: 6524 - protein, 188 aa, Homo sapiens
  Payload ID: 1410;
  Gene Symbol: AIP;
  Gene Name: aryl hydrocarbon receptor interacting prt;
  ENSP ID: ENSP00000476993
GQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKEQPGSPEWIQLDQQITPLLLNYCQCKLVVEEYYEVLDHCSSILNKYDGEHRALGCRGLRVVREWPFSCHCWGQDLAFHNPHSELPRGPD

SEQ ID NO: 6525 - protein, 321 aa, Homo sapiens
  Payload ID: 1411;
  Gene Symbol: AIPL1;
  Gene Name: aryl hydrocarbon receptor interacting prt-like 1;
  Uniprot ID:  Q9NZN9;
  ENSP ID: ENSP00000250087
MDAALLLNVEGVKKTILHGGTGELPNFITGSRVIFHFRTMKCDEERTVIDDSRQVGQPMHIIIGNMFKLEVWEILLTSMRVHEVAEFWCDTIVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 6526 - protein, 61 aa, Homo sapiens
  Payload ID: 1411;
  Gene Symbol: AIPL1;
  Gene Name: aryl hydrocarbon receptor interacting prt-like 1;
  ENSP ID: ENSP00000370520
MDAALLLNVEGVKKTILHGGTGELPNFITGSRVSGAPPEQTGSPTAAFNIPGDLSFPHHEM

SEQ ID NO: 6527 - protein, 384 aa, Homo sapiens
  Payload ID: 1411;
  Gene Symbol: AIPL1;
  Gene Name: aryl hydrocarbon receptor interacting prt-like 1;
  Uniprot ID:  Q9NZN9;
  ENSP ID: ENSP00000370521
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 6528 - protein, 372 aa, Homo sapiens
  Payload ID: 1411;
  Gene Symbol: AIPL1;
  Gene Name: aryl hydrocarbon receptor interacting prt-like 1;
  ENSP ID: ENSP00000458456
MDAALLLNVEGVKKTILHGGTGELPNFITGSRERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 6529 - protein, 324 aa, Homo sapiens
  Payload ID: 1411;
  Gene Symbol: AIPL1;
  Gene Name: aryl hydrocarbon receptor interacting prt-like 1;
  Uniprot ID:  Q9NZN9;
  ENSP ID: ENSP00000459522
MDAALLLNVEGVKKTILHGGTGELPNFITGSRHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 6530 - protein, 270 aa, Homo sapiens
  Payload ID: 1411;
  Gene Symbol: AIPL1;
  Gene Name: aryl hydrocarbon receptor interacting prt-like 1;
  ENSP ID: ENSP00000459673
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGARGCRGGQ

SEQ ID NO: 6531 - protein, 262 aa, Homo sapiens
  Payload ID: 1411;
  Gene Symbol: AIPL1;
  Gene Name: aryl hydrocarbon receptor interacting prt-like 1;
  ENSP ID: ENSP00000460134
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGARGCRGGQ

SEQ ID NO: 6532 - protein, 216 aa, Homo sapiens
  Payload ID: 1411;
  Gene Symbol: AIPL1;
  Gene Name: aryl hydrocarbon receptor interacting prt-like 1;
  ENSP ID: ENSP00000460672
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQLWGQVDAPSDYQRETWNLSNHEKMKAVPVLHGEGNRLFKLGRYEEASSKYQEAIICLRNLQ

SEQ ID NO: 6533 - protein, 360 aa, Homo sapiens
  Payload ID: 1411;
  Gene Symbol: AIPL1;
  Gene Name: aryl hydrocarbon receptor interacting prt-like 1;
  Uniprot ID:  Q9NZN9;
  ENSP ID: ENSP00000460827
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 6534 - protein, 362 aa, Homo sapiens
  Payload ID: 1411;
  Gene Symbol: AIPL1;
  Gene Name: aryl hydrocarbon receptor interacting prt-like 1;
  Uniprot ID:  Q9NZN9;
  ENSP ID: ENSP00000461287
MDAALLLNVEGVKKTILHGGTGELPNFITGSRVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENRMAEKQEEERLRCRNMLSQGATQPPAEPPTEPPAQSSTEPPAEPPTAPSAELSAGPPAEPATEPPPSPGHSLQH

SEQ ID NO: 6535 - protein, 136 aa, Homo sapiens
  Payload ID: 1411;
  Gene Symbol: AIPL1;
  Gene Name: aryl hydrocarbon receptor interacting prt-like 1;
  ENSP ID: ENSP00000467360
  MOD_RES (1)..(1): Any amino acid
XEGVKKTILHGGTGELPNFITGSRVIFHFRTMKCDEERTVIDDSRQVGQPMHIIIGNMFKLEVWEILLTSMRVHEVAEFWCDTIPEPTPSWFSPLNAKTAPLLSPHVQPAGMSSPSLEVFKEQPDAFLCFMLWVGG

SEQ ID NO: 6536 - protein, 326 aa, Homo sapiens
  Payload ID: 1411;
  Gene Symbol: AIPL1;
  Gene Name: aryl hydrocarbon receptor interacting prt-like 1;
  ENSP ID: ENSP00000481337
MDAALLLNVEGVKKTILHGGTGELPNFITGSRVIFHFRTMKCDEERTVIDDSRQVGQPMHIIIGNMFKLEVWEILLTSMRVHEVAEFWCDTIHTGVYPILSRSLRQMAQGKDPTEWHVHTCGLANMFAYHTLGYEDLDELQKEPQPLVFVIELLQVDAPSDYQRETWNLSNHEKMKAVPVLHGEGNRLFKLGRYEEASSKYQEAIICLRNLQTKEKPWEVQWLKLEKMINTLILNYCQCLLKKEEYYEVLEHTSDILRHHPGIVKAYYVRARAHAEVWNEAEAKADLQKVLELEPSMQKAVRRELRLLENAWRRSRRRSGCAAGTC

SEQ ID NO: 6537 - protein, 787 aa, Homo sapiens
  Payload ID: 1412;
  Gene Symbol: ARNT;
  Gene Name: aryl hydrocarbon receptor nuclear translocator;
  Uniprot ID:  P27540;
  ENSP ID: ENSP00000346372
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 6538 - protein, 789 aa, Homo sapiens
  Payload ID: 1412;
  Gene Symbol: ARNT;
  Gene Name: aryl hydrocarbon receptor nuclear translocator;
  Uniprot ID:  P27540;
  ENSP ID: ENSP00000351407
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 6539 - protein, 775 aa, Homo sapiens
  Payload ID: 1412;
  Gene Symbol: ARNT;
  Gene Name: aryl hydrocarbon receptor nuclear translocator;
  Uniprot ID:  P27540;
  ENSP ID: ENSP00000423851
MTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPADDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 6540 - protein, 55 aa, Homo sapiens
  Payload ID: 1412;
  Gene Symbol: ARNT;
  Gene Name: aryl hydrocarbon receptor nuclear translocator;
  ENSP ID: ENSP00000425363
MAATTANPEMTSDVPSLGPAIASGNSGPGIQGGGAIVQRAIKRRPGWSLAVVAQA

SEQ ID NO: 6541 - protein, 416 aa, Homo sapiens
  Payload ID: 1412;
  Gene Symbol: ARNT;
  Gene Name: aryl hydrocarbon receptor nuclear translocator;
  ENSP ID: ENSP00000425899
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQEL

SEQ ID NO: 6542 - protein, 774 aa, Homo sapiens
  Payload ID: 1412;
  Gene Symbol: ARNT;
  Gene Name: aryl hydrocarbon receptor nuclear translocator;
  Uniprot ID:  P27540;
  ENSP ID: ENSP00000427571
MAATTANPEMTSDVPSLGPAIASGNSGPGIQGGGAIVQRAIKRRPGLDFDDDGEGNSKFLRCDDDQMSNDKERFARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 6543 - protein, 625 aa, Homo sapiens
  Payload ID: 1413;
  Gene Symbol: ARNTL;
  Gene Name: aryl hydrocarbon receptor nuclear translocator-like;
  Uniprot ID:  O00327;
  ENSP ID: ENSP00000374357
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKDRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 6544 - protein, 626 aa, Homo sapiens
  Payload ID: 1413;
  Gene Symbol: ARNTL;
  Gene Name: aryl hydrocarbon receptor nuclear translocator-like;
  Uniprot ID:  O00327;
  ENSP ID: ENSP00000384517
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 6545 - protein, 582 aa, Homo sapiens
  Payload ID: 1413;
  Gene Symbol: ARNTL;
  Gene Name: aryl hydrocarbon receptor nuclear translocator-like;
  Uniprot ID:  O00327;
  ENSP ID: ENSP00000385581
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKDRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 6546 - protein, 624 aa, Homo sapiens
  Payload ID: 1413;
  Gene Symbol: ARNTL;
  Gene Name: aryl hydrocarbon receptor nuclear translocator-like;
  Uniprot ID:  O00327;
  ENSP ID: ENSP00000385897
MSKEAVSLWALTVSLQPPVPLCVCREMTGSGRRKQQCVTLPFISRELCFYLLLFPPPRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 6547 - protein, 583 aa, Homo sapiens
  Payload ID: 1413;
  Gene Symbol: ARNTL;
  Gene Name: aryl hydrocarbon receptor nuclear translocator-like;
  Uniprot ID:  O00327;
  ENSP ID: ENSP00000385915
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 6548 - protein, 100 aa, Homo sapiens
  Payload ID: 1413;
  Gene Symbol: ARNTL;
  Gene Name: aryl hydrocarbon receptor nuclear translocator-like;
  ENSP ID: ENSP00000431488
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVP

SEQ ID NO: 6549 - protein, 59 aa, Homo sapiens
  Payload ID: 1413;
  Gene Symbol: ARNTL;
  Gene Name: aryl hydrocarbon receptor nuclear translocator-like;
  ENSP ID: ENSP00000431566
MADQRMDISSTISDFMSPGPTDLLSSSLGTSGVDCNRKRKGSSTDYQESMDTDKDDPHG

SEQ ID NO: 6550 - protein, 76 aa, Homo sapiens
  Payload ID: 1413;
  Gene Symbol: ARNTL;
  Gene Name: aryl hydrocarbon receptor nuclear translocator-like;
  ENSP ID: ENSP00000433540
MADQRMDISSTISDFMSPGPTDLLSSSLGTSGVDCNRKRKGSSTDYQESMDTDKDDPHGRLEYTEHQGRIKNAREA

SEQ ID NO: 6551 - protein, 135 aa, Homo sapiens
  Payload ID: 1413;
  Gene Symbol: ARNTL;
  Gene Name: aryl hydrocarbon receptor nuclear translocator-like;
  ENSP ID: ENSP00000433571
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEA

SEQ ID NO: 6552 - protein, 23 aa, Homo sapiens
  Payload ID: 1413;
  Gene Symbol: ARNTL;
  Gene Name: aryl hydrocarbon receptor nuclear translocator-like;
  ENSP ID: ENSP00000434044
MADQRMDISSTISDFMSPGPTDL

SEQ ID NO: 6553 - protein, 46 aa, Homo sapiens
  Payload ID: 1413;
  Gene Symbol: ARNTL;
  Gene Name: aryl hydrocarbon receptor nuclear translocator-like;
  ENSP ID: ENSP00000434263
MINIESMDTDKDDPHGRLEYTEHQGRIKNAREAHSQIEKRRRDKMN

SEQ ID NO: 6554 - protein, 60 aa, Homo sapiens
  Payload ID: 1413;
  Gene Symbol: ARNTL;
  Gene Name: aryl hydrocarbon receptor nuclear translocator-like;
  ENSP ID: ENSP00000434781
MADQRMDISSTISDFMSPGPTDLLSSSLGTSGVDCNRKRKGSSTDYQLEYTEHQGRIKNA

SEQ ID NO: 6555 - protein, 141 aa, Homo sapiens
  Payload ID: 1413;
  Gene Symbol: ARNTL;
  Gene Name: aryl hydrocarbon receptor nuclear translocator-like;
  ENSP ID: ENSP00000436313
MINIESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQ

SEQ ID NO: 6556 - protein, 171 aa, Homo sapiens
  Payload ID: 1413;
  Gene Symbol: ARNTL;
  Gene Name: aryl hydrocarbon receptor nuclear translocator-like;
  ENSP ID: ENSP00000436442
RATAILAYLPQELLGTSCYEYFHQDDIGHLAECHRQVLQTREKITTNCYKFKIKDGSFITLRSRWFSFMNPWTKEVEYIVSTNTVVLSRVDTGHLGQVEWCTVLSRPDSRFLIAGMFTEPTSWKAGTQPSHSSQHPPTAWTACCPLEKVAQRGPTPLFQGFQGEPGLGQEK

SEQ ID NO: 6557 - protein, 72 aa, Homo sapiens
  Payload ID: 1413;
  Gene Symbol: ARNTL;
  Gene Name: aryl hydrocarbon receptor nuclear translocator-like;
  ENSP ID: ENSP00000436721
MINIESMDTDKDDPHGRLEYTEHQGRIKNAREAHSQIEKRRRDKMNSFIDELASLVPTCNAMSRKLDKLTVL

SEQ ID NO: 6558 - protein, 588 aa, Homo sapiens
  Payload ID: 1414;
  Gene Symbol: ARNTL2;
  Gene Name: aryl hydrocarbon receptor nuclear translocator-like 2;
  Uniprot ID:  Q8WYA1;
  ENSP ID: ENSP00000261178
MAAEEEAAAGGKVLREENQCIAPVVSSRVSPGTRPTAMGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 6559 - protein, 636 aa, Homo sapiens
  Payload ID: 1414;
  Gene Symbol: ARNTL2;
  Gene Name: aryl hydrocarbon receptor nuclear translocator-like 2;
  Uniprot ID:  Q8WYA1;
  ENSP ID: ENSP00000266503
MAAEEEAAAGGKVLREENQCIAPVVSSRVSPGTRPTAMGSFSSHMTEFPRKRKGSDSDPSQSGIMTEKVVEKLSQNPLTYLLSTRIEISASSGSRVEDGEHQVKMKAFREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 6560 - protein, 622 aa, Homo sapiens
  Payload ID: 1414;
  Gene Symbol: ARNTL2;
  Gene Name: aryl hydrocarbon receptor nuclear translocator-like 2;
  Uniprot ID:  Q8WYA1;
  ENSP ID: ENSP00000312247
MAAEEEAAAGGKVLREENQCIAPVVSSRVSPGTRPTAMGSFSSHMTEFPRKRKGSDSDPSQSGIMTEKVVEKLSQNPLTYLLSTRIEISASSGSREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 6561 - protein, 599 aa, Homo sapiens
  Payload ID: 1414;
  Gene Symbol: ARNTL2;
  Gene Name: aryl hydrocarbon receptor nuclear translocator-like 2;
  Uniprot ID:  Q8WYA1;
  ENSP ID: ENSP00000379238
MAAEEEAAAGGEVAGGEATAPGKVLREENQCIAPVVSSRVSPGTRPTAMGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 6562 - protein, 588 aa, Homo sapiens
  Payload ID: 1414;
  Gene Symbol: ARNTL2;
  Gene Name: aryl hydrocarbon receptor nuclear translocator-like 2;
  ENSP ID: ENSP00000400185
  MOD_RES (1)..(1): Any amino acid
XPVVSSRVSPGTRPTAMGSFSSHMTEFPRKRKGSDSDPSHQNPLTYLLSTRIEISASSGSREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 6563 - protein, 540 aa, Homo sapiens
  Payload ID: 1414;
  Gene Symbol: ARNTL2;
  Gene Name: aryl hydrocarbon receptor nuclear translocator-like 2;
  Uniprot ID:  Q8WYA1;
  ENSP ID: ENSP00000438545
MAAEEEAAAGGEVAGGEATAPGKVLREENQCIAPVVSSRVSPGTRPTAMGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSVMVHSWISMPYVTMMTQPWLHL

SEQ ID NO: 6564 - protein, 602 aa, Homo sapiens
  Payload ID: 1414;
  Gene Symbol: ARNTL2;
  Gene Name: aryl hydrocarbon receptor nuclear translocator-like 2;
  Uniprot ID:  Q8WYA1;
  ENSP ID: ENSP00000442438
MAAEEEAAAGGKVLREENQCIAPVVSSRVSPGTRPTAMGSFSSHMTEFPRKRKGSDSDPSQVEDGEHQVKMKAFREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 6565 - protein, 551 aa, Homo sapiens
  Payload ID: 1414;
  Gene Symbol: ARNTL2;
  Gene Name: aryl hydrocarbon receptor nuclear translocator-like 2;
  Uniprot ID:  Q8WYA1;
  ENSP ID: ENSP00000445836
MGSFSSHMTEFPRKRKGSDSDPSQEAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 6566 - protein, 399 aa, Homo sapiens
  Payload ID: 1415;
  Gene Symbol: AADAC;
  Gene Name: arylacetamide deacetylase;
  Uniprot ID:  P22760;
  ENSP ID: ENSP00000232892
MGRKSLYLLIVGILIAYYIYTPLPDNVEEPWRMMWINAHLKTIQNLATFVELLGLHHFMDSFKVVGSFDEVPPTSDENVTVTETKFNNILVRVYVPKRKSEALRRGLFYIHGGGWCVGSAALSGYDLLSRWTADRLDAVVVSTNYRLAPKYHFPIQFEDVYNALRWFLRKKVLAKYGVNPERIGISGDSAGGNLAAAVTQQLLDDPDVKIKLKIQSLIYPALQPLDVDLPSYQENSNFLFLSKSLMVRFWSEYFTTDRSLEKAMLSRQHVPVESSHLFKFVNWSSLLPERFIKGHVYNNPNYGSSELAKKYPGFLDVRAAPLLADDNKLRGLPLTYVITCQYDLLRDDGLMYVTRLRNTGVQVTHNHVEDGFHGAFSFLGLKISHRLINQYIEWLKENL

SEQ ID NO: 6567 - protein, 204 aa, Homo sapiens
  Payload ID: 1415;
  Gene Symbol: AADAC;
  Gene Name: arylacetamide deacetylase;
  ENSP ID: ENSP00000419620
MGRKSLYLLIVGILIAYYIYTPLPDNVEEPWRMMWINAHLKTIQNLATFVELLGLHHFMDSFKVVGSFDEVPPTSDENVTVTETKFNNILVRVYVPKRKSEALRRGLFYIHGGGWCVGSAALSGYDLLSRWTADRLDAVVVSTNYRLAPKYHFPIQFEDVYNALRWFLRKKVLAKYGVNPERIGISGDSAGGNLAAAVTQQVCS

SEQ ID NO: 6568 - protein, 401 aa, Homo sapiens
  Payload ID: 1416;
  Gene Symbol: AADACL2;
  Gene Name: arylacetamide deacetylase-like 2;
  Uniprot ID:  Q6P093;
  ENSP ID: ENSP00000348911
MGLKALCLGLLCVLFVSHFYTPMPDNIEESWKIMALDAIAKTCTFTAMCFENMRIMRYEEFISMIFRLDYTQPLSDEYITVTDTTFVDIPVRLYLPKRKSETRRRAVIYFHGGGFCFGSSKQRAFDFLNRWTANTLDAVVVGVDYRLAPQHHFPAQFEDGLAAVKFFLLEKILTKYGVDPTRICIAGDSSGGNLATAVTQQVQNDAEIKHKIKMQVLLYPGLQITDSYLPSHRENEHGIVLTRDVAIKLVSLYFTKDEALPWAMRRNQHMPLESRHLFKFVNWSILLPEKYRKDYVYTEPILGGLSYSLPGLTDSRALPLLANDSQLQNLPLTYILTCQHDLLRDDGLMYVTRLRNVGVQVVHEHIEDGIHGALSFMTSPFYLRLGLRIRDMYVSWLDKNL

SEQ ID NO: 6569 - protein, 53 aa, Homo sapiens
  Payload ID: 1416;
  Gene Symbol: AADACL2;
  Gene Name: arylacetamide deacetylase-like 2;
  ENSP ID: ENSP00000387390
MGLKALCLGLLCVLFVSHFYTPMPDNIEESWKIMALDAIAKTCTFTNRGLLTS

SEQ ID NO: 6570 - protein, 401 aa, Homo sapiens; identical to SEQ ID NO: 6568
  Payload ID: 1416;
  Gene Symbol: AADACL2;
  Gene Name: arylacetamide deacetylase-like 2;
  Uniprot ID:  Q6P093;
  ENSP ID: ENSP00000461239

SEQ ID NO: 6571 - protein, 53 aa, Homo sapiens; identical to SEQ ID NO: 6569
  Payload ID: 1416;
  Gene Symbol: AADACL2;
  Gene Name: arylacetamide deacetylase-like 2;
  ENSP ID: ENSP00000461479

SEQ ID NO: 6572 - protein, 407 aa, Homo sapiens
  Payload ID: 1417;
  Gene Symbol: AADACL3;
  Gene Name: arylacetamide deacetylase-like 3;
  Uniprot ID:  Q5VUY0;
  ENSP ID: ENSP00000352268
MWDLALIFLAAACVFSLGVTLWVICSHFFTVHIPAAVGHPVKLRVLHCIFQLLLTWGMIFEKLRICSMPQFFCFMQDLPPLKYDPDVVVTDFRFGTIPVKLYQPKASTCTLKPGIVYYHGGGGVMGSLKTHHGICSRLCKESDSVVLAVGYRKLPKHKFPVPVRDCLVATIHFLKSLDAYGVDPARVVVCGDSFGGAIAAVVCQQLVDRPDLPRIRAQILIYAILQALDLQTPSFQQRKNIPLLTWSFICYFFFQNLDFSSSWQEVIMKGAHLPAEVWEKYRKWLGPENIPERFKERGYQLKPHEPMNEAAYLEVSVVLDVMCSPLIAEDDIVSQLPETCIVSCEYDALRDNSLLYKKRLEDLGVPVTWHHMEDGFHGVLRTIDMSFLHFPCSMRILSALVQFVKGL

SEQ ID NO: 6573 - protein, 407 aa, Homo sapiens
  Payload ID: 1418;
  Gene Symbol: AADACL4;
  Gene Name: arylacetamide deacetylase-like 4;
  Uniprot ID:  Q5VUY2;
  ENSP ID: ENSP00000365395
MAVPWLVLLLALPIFFLGVFVWAVFEHFLTTDIPATLQHPAKLRFLHCIFLYLVTLGNIFEKLGICSMPKFIRFLHDSVRIKKDPELVVTDLRFGTIPVRLFQPKAASSRPRRGIIFYHGGATVFGSLDCYHGLCNYLARETESVLLMIGYRKLPDHHSPALFQDCMNASIHFLKALETYGVDPSRVVVCGESVGGAAVAAITQALVGRSDLPRIRAQVLIYPVVQAFCLQLPSFQQNQNVPLLSRKFMVTSLCNYLAIDLSWRDAILNGTCVPPDVWRKYEKWLSPDNIPKKFKNRGYQPWSPGPFNEAAYLEAKHMLDVENSPLIADDEVIAQLPEAFLVSCENDILRDDSLLYKKRLEDQGVRVTWYHLYDGFHGSIIFFDKKALSFPCSLKIVNAVVSYIKGI

SEQ ID NO: 6574 - protein, 308 aa, Homo sapiens
  Payload ID: 1419;
  Gene Symbol: AFMID;
  Gene Name: arylformamidase;
  Uniprot ID:  Q63HM1;
  ENSP ID: ENSP00000328938
MMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGSKDESAFMVHPLTAQGVAVVIVAYGIAPKGTLDHMVDQVTRSVAFVQKRYPSNKGIYLCGHSAGAHLAAMMLLADWTKHGVTPNLRGFFLVSGVFDLEPIVYTSQNVALQLTLEDAQRNSPQLKVAQAQPVDPTCRVLVVVGQFDSPEFHRQSWEFYQVLPVQTLCQGEWKASFEELHDVDHFEIVENLTQKDNVLTQIILKTIFQ

SEQ ID NO: 6575 - protein, 303 aa, Homo sapiens
  Payload ID: 1419;
  Gene Symbol: AFMID;
  Gene Name: arylformamidase;
  Uniprot ID:  Q63HM1;
  ENSP ID: ENSP00000386890
MMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGSKDESAFMVHPLTAQGVAVVIVAYGIAPKGTLDHMVDQVTRSVAFVQKRYPSNKGIYLCGHSAGAHLAAMMLLADWTKHGVTPNLRGFFLVSGVFDLEPIVYTSQNVALQLTLEDAQRNSPQLKVAQAQPVDPTCRVLVVVGQFDSPEFHRQSWEFYQTLCQGEWKASFEELHDVDHFEIVENLTQKDNVLTQIILKTIFQ

SEQ ID NO: 6576 - protein, 93 aa, Homo sapiens
  Payload ID: 1419;
  Gene Symbol: AFMID;
  Gene Name: arylformamidase;
  ENSP ID: ENSP00000464929
MMDVSGVGFPSKVPWKKMSAEELENQYCPSRWVVRLGAEEALRTYSQIGIEALPFFLFFHGGYWQSGRPCVKESGKPHLKSSTMWTTLKLLRI

SEQ ID NO: 6577 - protein, 111 aa, Homo sapiens
  Payload ID: 1419;
  Gene Symbol: AFMID;
  Gene Name: arylformamidase;
  ENSP ID: ENSP00000465406
MMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGRLFPGEWGL

SEQ ID NO: 6578 - protein, 37 aa, Homo sapiens
  Payload ID: 1419;
  Gene Symbol: AFMID;
  Gene Name: arylformamidase;
  ENSP ID: ENSP00000466241
MSAEELENQYCPSRWVVRLGAEEALRTYSQIGIEVHL

SEQ ID NO: 6579 - protein, 206 aa, Homo sapiens
  Payload ID: 1419;
  Gene Symbol: AFMID;
  Gene Name: arylformamidase;
  ENSP ID: ENSP00000466515
MMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGSKDESAFMVHPLTAQGVAVVIVAYGIAPKGTLDHMVDQVTRSVAFVQKRYPSNKWVLPVDFLPVGPQWVGGQCNQYLGYSQAAPLACGAESKLGLFEGGLMLWG

SEQ ID NO: 6580 - protein, 187 aa, Homo sapiens
  Payload ID: 1419;
  Gene Symbol: AFMID;
  Gene Name: arylformamidase;
  ENSP ID: ENSP00000466566
MMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGRHPGPHGRPGDPQRCVCPEAVSKQQVGVASRFSSCWTSVGGRTVQSVPRIQPSCPSGLWSRKQIGTLRRGPDVVGKLRANPALCS

SEQ ID NO: 6581 - protein, 57 aa, Homo sapiens
  Payload ID: 1419;
  Gene Symbol: AFMID;
  Gene Name: arylformamidase;
  ENSP ID: ENSP00000466859
MMDVSGVGFPSKVPWKKMSAEELENQYCPSRWVVRLGAEEALRTYSQIGIEGLRTPV

SEQ ID NO: 6582 - protein, 84 aa, Homo sapiens
  Payload ID: 1419;
  Gene Symbol: AFMID;
  Gene Name: arylformamidase;
  ENSP ID: ENSP00000467365
MMDVSGVGFPSKVPWKKMSAEELENQYCPSRWVVRLGAEEALRTYSQIGIEDYLENNLPVVLTILGAWSTCIPPWEASPKSFRS

SEQ ID NO: 6583 - protein, 60 aa, Homo sapiens
  Payload ID: 1419;
  Gene Symbol: AFMID;
  Gene Name: arylformamidase;
  ENSP ID: ENSP00000467869
MMDVSGVGFPSKVPWKKMSAEELENQYCPSRWVVRLGAEEALRTYSQIGIEEIWTWEPVN

SEQ ID NO: 6584 - protein, 717 aa, Homo sapiens
  Payload ID: 1420;
  Gene Symbol: ARNT2;
  Gene Name: aryl-hydrocarbon receptor nuclear translocator 2;
  Uniprot ID:  Q9HBZ2;
  ENSP ID: ENSP00000307479
MATPAAVNPPEMASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSE

SEQ ID NO: 6585 - protein, 130 aa, Homo sapiens
  Payload ID: 1420;
  Gene Symbol: ARNT2;
  Gene Name: aryl-hydrocarbon receptor nuclear translocator 2;
  ENSP ID: ENSP00000452961
MRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCIS

SEQ ID NO: 6586 - protein, 706 aa, Homo sapiens
  Payload ID: 1420;
  Gene Symbol: ARNT2;
  Gene Name: aryl-hydrocarbon receptor nuclear translocator 2;
  Uniprot ID:  Q9HBZ2;
  ENSP ID: ENSP00000453651
MASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSE

SEQ ID NO: 6587 - protein, 706 aa, Homo sapiens; identical to SEQ ID NO: 6586
  Payload ID: 1420;
  Gene Symbol: ARNT2;
  Gene Name: aryl-hydrocarbon receptor nuclear translocator 2;
  Uniprot ID:  Q9HBZ2;
  ENSP ID: ENSP00000453792

SEQ ID NO: 6588 - protein, 716 aa, Homo sapiens [sequence omitted]

SEQ ID NO: 6589 - protein, 566 aa, Homo sapiens
  Payload ID: 1420;
  Gene Symbol: ARNT2;
  Gene Name: aryl-hydrocarbon receptor nuclear translocator 2;
  ENSP ID: ENSP00000483762
MATPAAVNPPEMASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISGS

SEQ ID NO: 6590 - protein, 719 aa, Homo sapiens
  Payload ID: 1421;
  Gene Symbol: AHRR;
  Gene Name: aryl-hydrocarbon receptor repressor;
  Uniprot ID:  A9YTQ3;
  ENSP ID: ENSP00000323816
MPRTMIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYDYIHVDDRQDFCRQLHWAMDPPQVVFGQPPPLETGDDAILGRLLRAQEWGTGTPTEYSAFLTRCFICRVRCLLDSTSGFLARGSQAWQLRLCCPEPLMTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 6591 - protein, 701 aa, Homo sapiens
  Payload ID: 1421;
  Gene Symbol: AHRR;
  Gene Name: aryl-hydrocarbon receptor repressor;
  Uniprot ID:  A9YTQ3;
  ENSP ID: ENSP00000424601
MPRTMIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYDYIHVDDRQDFCRQLHWAMDPPQVVFGQPPPLETGDDAILGRLLRAQEWGTGTPTEYSAFLTRCFICRVRCLLDSTSGFLTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 6592 - protein, 547 aa, Homo sapiens [sequence omitted]

SEQ ID NO: 6593 - protein, 215 aa, Homo sapiens
  Payload ID: 1421;
  Gene Symbol: AHRR;
  Gene Name: aryl-hydrocarbon receptor repressor;
  ENSP ID: ENSP00000426076
LLPSAAEMKMRSALLRAKPRADTAATADAKDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLG

SEQ ID NO: 6594 - protein, 557 aa, Homo sapiens
  Payload ID: 1421;
  Gene Symbol: AHRR;
  Gene Name: aryl-hydrocarbon receptor repressor;
  ENSP ID: ENSP00000426932
MRGRGMPTDVMHQNIYDYIHVDDRQDFCRQLHWAMDPPQVVFGQPPPLETGDDAILGRLLRAQEWGTGTPTEYSAFLTRCFICRVRCLLDSTSGFLTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 6595 - protein, 157 aa, Homo sapiens
  Payload ID: 1421;
  Gene Symbol: AHRR;
  Gene Name: aryl-hydrocarbon receptor repressor;
  ENSP ID: ENSP00000428893
MIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYD

SEQ ID NO: 6596 - protein, 81 aa, Homo sapiens
  Payload ID: 1421;
  Gene Symbol: AHRR;
  Gene Name: aryl-hydrocarbon receptor repressor;
  ENSP ID: ENSP00000429944
MIPPGECTYAGRKRRRPLQKQRPAVGAEKSNPSKRHRDRLNAELDHLASLLPFPPDIISKLDKLSVLRLSVSYLRVKSFFQ

SEQ ID NO: 6597 - protein, 139 aa, Homo sapiens
  Payload ID: 1421;
  Gene Symbol: AHRR;
  Gene Name: aryl-hydrocarbon receptor repressor;
  ENSP ID: ENSP00000430842
MIPPGECTYAGRKRRRPLQKQRPAVGAEKSNPSKRHRDRLNAELDHLASLLPFPPDIISKLDKLSVLRLSVSYLRVKSFFQGQGLAVADAEDVDDHTGERRPMSFRRPRALDTQALRRTQFGLHLLMVNIAGLIATDRL

SEQ ID NO: 6598 - protein, 12 aa, Homo sapiens
  Payload ID: 1421;
  Gene Symbol: AHRR;
  Gene Name: aryl-hydrocarbon receptor repressor;
  ENSP ID: ENSP00000430914
MHQNIYDYIHVD

SEQ ID NO: 6599 - protein, 509 aa, Homo sapiens
  Payload ID: 1422;
  Gene Symbol: ARSA;
  Gene Name: arylsulfatase A;
  ENSP ID: ENSP00000216124
MSMGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 6600 - protein, 509 aa, Homo sapiens; identical to SEQ ID NO: 6599
  Payload ID: 1422;
  Gene Symbol: ARSA;
  Gene Name: arylsulfatase A;
  ENSP ID: ENSP00000348406

SEQ ID NO: 6601 - protein, 509 aa, Homo sapiens; identical to SEQ ID NO: 6599
  Payload ID: 1422;
  Gene Symbol: ARSA;
  Gene Name: arylsulfatase A;
  ENSP ID: ENSP00000378981

SEQ ID NO: 6602 - protein, 509 aa, Homo sapiens; identical to SEQ ID NO: 6599
  Payload ID: 1422;
  Gene Symbol: ARSA;
  Gene Name: arylsulfatase A;
  ENSP ID: ENSP00000378983

SEQ ID NO: 6603 - protein, 423 aa, Homo sapiens
  Payload ID: 1422;
  Gene Symbol: ARSA;
  Gene Name: arylsulfatase A;
  Uniprot ID:  P15289;
  ENSP ID: ENSP00000412542
MGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 6604 - protein, 69 aa, Homo sapiens
  Payload ID: 1422;
  Gene Symbol: ARSA;
  Gene Name: arylsulfatase A;
  ENSP ID: ENSP00000477013
  MOD_RES (1)..(1): Any amino acid
XPSYPDEVRGVFAVRTGKYKAHFFTQGSAHSDTTADPACHASSSLTAHEPPLLYDLSKDPDGVSLCRPG

SEQ ID NO: 6605 - protein, 533 aa, Homo sapiens
  Payload ID: 1423;
  Gene Symbol: ARSB;
  Gene Name: arylsulfatase B;
  Uniprot ID:  P15848;
  ENSP ID: ENSP00000264914
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 6606 - protein, 413 aa, Homo sapiens
  Payload ID: 1423;
  Gene Symbol: ARSB;
  Gene Name: arylsulfatase B;
  Uniprot ID:  P15848;
  ENSP ID: ENSP00000379455
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPYWPECSLLL

SEQ ID NO: 6607 - protein, 45 aa, Homo sapiens
  Payload ID: 1423;
  Gene Symbol: ARSB;
  Gene Name: arylsulfatase B;
  ENSP ID: ENSP00000428611
MGPRGAASLPRGPGPRRLLLPVVLPLLLLLLLAPPGSGAGASRPP

SEQ ID NO: 6608 - protein, 413 aa, Homo sapiens; identical to SEQ ID NO: 6606
  Payload ID: 1423;
  Gene Symbol: ARSB;
  Gene Name: arylsulfatase B;
  Uniprot ID:  P15848;
  ENSP ID: ENSP00000456339

SEQ ID NO: 6609 - protein, 593 aa, Homo sapiens
  Payload ID: 1424;
  Gene Symbol: ARSD;
  Gene Name: arylsulfatase D;
  Uniprot ID:  P51689;
  ENSP ID: ENSP00000370546
MRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFSVSARAVTGMAGVGCLFFISWYSSFGFVRRWNCILMRNHDVTEQPMVLEKTASLMLKEAVSYIERHKHGPFLLFLSLLHVHIPLVTTSAFLGKSQHGLYGDNVEEMDWLIGKVLNAIEDNGLKNSTFTYFTSDHGGHLEARDGHSQLGGWNGIYKGGKGMGGWEGGIRVPGIFHWPGVLPAGRVIGEPTSLMDVFPTVVQLVGGEVPQDRVIDGHSLVPLLQGAEARSAHEFLFHYCGQHLHAARWHQKDSGSVWKVHYTTPQFHPEGAGACYGRGVCPCSGEGVTHHRPPLLFDLSRDPSEARPLTPDSEPLYHAVIARVGAAVSEHRQTLSPVPQQFSMSNILWKPWLQPCCGHFPFCSCHEDGDGTP

SEQ ID NO: 6610 - protein, 159 aa, Homo sapiens
  Payload ID: 1424;
  Gene Symbol: ARSD;
  Gene Name: arylsulfatase D;
  ENSP ID: ENSP00000409180
PGVLPAGRVIGEPTSLMDVFPTVVQLVGGEVPQDRVIDGHSLVPLLQGAEARSAHEFLFHYCGQHLHAARWHQKDSGSVWKVHYTTPQFHPEGAGACYGRGVCPCSGEGVTHHRPPLLFDLSRDPSEARPLTPDSEPLYHAVIARGHLLAELNLKPKRR

SEQ ID NO: 6611 - protein, 82 aa, Homo sapiens
  Payload ID: 1424;
  Gene Symbol: ARSD;
  Gene Name: arylsulfatase D;
  ENSP ID: ENSP00000453789
MRSAARRGRAAPAARDSLPVLLFLCLLLKTCEPKTANAFKPNILLIMADDLGTGDLGCYGNNTLRDRFSLCCQGLSRTPGLK

SEQ ID NO: 6612 - protein, 589 aa, Homo sapiens
  Payload ID: 1425;
  Gene Symbol: ARSE;
  Gene Name: arylsulfatase E (chondrodysplasia punctata 1);
  Uniprot ID:  P51690;
  ENSP ID: ENSP00000370526
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 6613 - protein, 178 aa, Homo sapiens
  Payload ID: 1425;
  Gene Symbol: ARSE;
  Gene Name: arylsulfatase E (chondrodysplasia punctata 1);
  ENSP ID: ENSP00000406528
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLM

SEQ ID NO: 6614 - protein, 544 aa, Homo sapiens
  Payload ID: 1425;
  Gene Symbol: ARSE;
  Gene Name: arylsulfatase E (chondrodysplasia punctata 1);
  ENSP ID: ENSP00000438198
MSGSRERDNMLHLHHSWTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 6615 - protein, 614 aa, Homo sapiens
  Payload ID: 1425;
  Gene Symbol: ARSE;
  Gene Name: arylsulfatase E (chondrodysplasia punctata 1);
  ENSP ID: ENSP00000441417
MRPVINRCAPGSLDLMLPQAASEGIVFHSLQISLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 6616 - protein, 590 aa, Homo sapiens
  Payload ID: 1426;
  Gene Symbol: ARSF;
  Gene Name: arylsulfatase F;
  Uniprot ID:  P54793;
  ENSP ID: ENSP00000352319
MRPRRPLVFMSLVCALLNTCQAHRVHDDKPNIVLIMVDDLGIGDLGCYGNDTMRTPHIDRLAREGVRLTQHISAASLCSPSRSAFLTGRYPIRSGMVSSGNRRVIQNLAVPAGLPLNETTLAALLKKQGYSTGLIGKWHQGLNCDSRSDQCHHPYNYGFDYYYGMPFTLVDSCWPDPSRNTELAFESQLWLCVQLVAIAILTLTFGKLSGWVSVPWLLIFSMILFIFLLGYAWFSSHTSPLYWDCLLMRGHEITEQPMKAERAGSIMVKEAISFLERHSKETFLLFFSFLHVHTPLPTTDDFTGTSKHGLYGDNVEEMDSMVGKILDAIDDFGLRNNTLVYFTSDHGGHLEARRGHAQLGGWNGIYKGGKGMGGWEGGIRVPGIVRWPGKVPAGRLIKEPTSLMDILPTVASVSGGSLPQDRVIDGRDLMPLLQGNVRHSEHEFLFHYCGSYLHAVRWIPKDDSGSVWKAHYVTPVFQPPASGGCYVTSLCRCFGEQVTYHNPPLLFDLSRDPSESTPLTPATEPLHDFVIKKVANALKEHQETIVPVTYQLSELNQGRTWLKPCCGVFPFCLCDKEEEVSQPRGPNEKR

SEQ ID NO: 6617 - protein, 590 aa, Homo sapiens; identical to SEQ ID NO: 6616
  Payload ID: 1426;
  Gene Symbol: ARSF;
  Gene Name: arylsulfatase F;
  Uniprot ID:  P54793;
  ENSP ID: ENSP00000370519

SEQ ID NO: 6618 - protein, 562 aa, Homo sapiens
  Payload ID: 1427;
  Gene Symbol: ARSH;
  Gene Name: arylsulfatase family, member H;
  Uniprot ID:  Q5FYA8;
  ENSP ID: ENSP00000370522
MTRNARPNIVLLMADDLGVGDLCCYGNNSVSTPNIDRLASEGVRLTQHLAAASMCTPSRAAFLTGRYPIRSGMVSAYNLNRAFTWLGGSGGLPTNETTFAKLLQHRGYRTGLIGKWHLGLSCASRNDHCYHPLNHGFHYFYGVPFGLLSDCQASKTPELHRWLRIKLWISTVALALVPFLLLIPKFARWFSVPWKVIFVFALLAFLFFTSWYSSYGFTRRWNCILMRNHEIIQQPMKEEKVASLMLKEALAFIERYKREPFLLFFSFLHVHTPLISKKKFVGRSKYGRYGDNVEEMDWMVGKILDALDQERLANHTLVYFTSDNGGHLEPLDGAVQLGGWNGIYKGGKGMGGWEGGIRVPGIFRWPSVLEAGRVINEPTSLMDIYPTLSYIGGGILSQDRVIDGQNLMPLLEGRASHSDHEFLFHYCGVYLHTVRWHQKDCATVWKAHYVTPKFYPEGTGACYGSGICSCSGDVTYHDPPLLFDISRDPSEALPLNPDNEPLFDSVIKKMEAAIREHRRTLTPVPQQFSVFNTIWKPWLQPCCGTFPFCGCDKEDDILPMAP

SEQ ID NO: 6619 - protein, 569 aa, Homo sapiens
  Payload ID: 1428;
  Gene Symbol: ARSI;
  Gene Name: arylsulfatase family, member I;
  Uniprot ID:  Q5FYB1;
  ENSP ID: ENSP00000333395
MHTLTGFSLVSLLSFGYLSWDWAKPSFVADGPGEAGEQPSAAPPQPPHIIFILTDDQGYHDVGYHGSDIETPTLDRLAAKGVKLENYYIQPICTPSRSQLLTGRYQIHTGLQHSIIRPQQPNCLPLDQVTLPQKLQEAGYSTHMVGKWHLGFYRKECLPTRRGFDTFLGSLTGNVDYYTYDNCDGPGVCGFDLHEGENVAWGLSGQYSTMLYAQRASHILASHSPQRPLFLYVAFQAVHTPLQSPREYLYRYRTMGNVARRKYAAMVTCMDEAVRNITWALKRYGFYNNSVIIFSSDNGGQTFSGGSNWPLRGRKGTYWEGGVRGLGFVHSPLLKRKQRTSRALMHITDWYPTLVGLAGGTTSAADGLDGYDVWPAISEGRASPRTEILHNIDPLYNHAQHGSLEGGFGIWNTAVQAAIRVGEWKLLTGDPGYGDWIPPQTLATFPGSWWNLERMASVRQAVWLFNISADPYEREDLAGQRPDVVRTLLARLAEYNRTAIPVRYPAENPRAHPDFNGGAWGPWASDEEEEEEEGRARSFSRGRRKKKCKICKLRSFFRKLNTRLMSQRI

SEQ ID NO: 6620 - protein, 86 aa, Homo sapiens
  Payload ID: 1428;
  Gene Symbol: ARSI;
  Gene Name: arylsulfatase family, member I;
  ENSP ID: ENSP00000420955
MVGKWHLGFYRKECLPTRRGFDTFLGSLTGNVDYYTYDNCDGPGVCGFDLHEGENVAWGLSGQYSTMLYAQRASHILASHSPQRPL

SEQ ID NO: 6621 - protein, 426 aa, Homo sapiens
  Payload ID: 1428;
  Gene Symbol: ARSI;
  Gene Name: arylsulfatase family, member I;
  Uniprot ID:  Q5FYB1;
  ENSP ID: ENSP00000426879
MVGKWHLGFYRKECLPTRRGFDTFLGSLTGNVDYYTYDNCDGPGVCGFDLHEGENVAWGLSGQYSTMLYAQRASHILASHSPQRPLFLYVAFQAVHTPLQSPREYLYRYRTMGNVARRKYAAMVTCMDEAVRNITWALKRYGFYNNSVIIFSSDNGGQTFSGGSNWPLRGRKGTYWEGGVRGLGFVHSPLLKRKQRTSRALMHITDWYPTLVGLAGGTTSAADGLDGYDVWPAISEGRASPRTEILHNIDPLYNHAQHGSLEGGFGIWNTAVQAAIRVGEWKLLTGDPGYGDWIPPQTLATFPGSWWNLERMASVRQAVWLFNISADPYEREDLAGQRPDVVRTLLARLAEYNRTAIPVRYPAENPRAHPDFNGGAWGPWASDEEEEEEEGRARSFSRGRRKKKCKICKLRSFFRKLNTRLMSQRI

SEQ ID NO: 6622 - protein, 599 aa, Homo sapiens
  Payload ID: 1429;
  Gene Symbol: ARSJ;
  Gene Name: arylsulfatase family, member J;
  Uniprot ID:  Q5FYB0;
  ENSP ID: ENSP00000320219
MAPRGCAGHPPPPSPQACVCPGKMLAMGALAGFWILCLLTYGYLSWGQALEEEEEGALLAQAGEKLEPSTTSTSQPHLIFILADDQGFRDVGYHGSEIKTPTLDKLAAEGVKLENYYVQPICTPSRSQFITGKYQIHTGLQHSIIRPTQPNCLPLDNATLPQKLKEVGYSTHMVGKWHLGFYRKECMPTRRGFDTFFGSLLGSGDYYTHYKCDSPGMCGYDLYENDNAAWDYDNGIYSTQMYTQRVQQILASHNPTKPIFLYIAYQAVHSPLQAPGRYFEHYRSIININRRRYAAMLSCLDEAINNVTLALKTYGFYNNSIIIYSSDNGGQPTAGGSNWPLRGSKGTYWEGGIRAVGFVHSPLLKNKGTVCKELVHITDWYPTLISLAEGQIDEDIQLDGYDIWETISEGLRSPRVDILHNIDPIYTKAKNGSWAAGYGIWNTAIQSAIRVQHWKLLTGNPGYSDWVPPQSFSNLGPNRWHNERITLSTGKSVWLFNITADPYERVDLSNRYPGIVKKLLRRLSQFNKTAVPVRYPPKDPRSNPRLNGGVWGPWYKEETKKKKPSKNQAEKKQKKSKKKKKKQQKAVSGSTCHSGVTCG

SEQ ID NO: 6623 - protein, 133 aa, Homo sapiens
  Payload ID: 1429;
  Gene Symbol: ARSJ;
  Gene Name: arylsulfatase family, member J;
  ENSP ID: ENSP00000421327
MAPRGCAGHPPPPSPQACVCPGKMLAMGALAGFWILCLLTYGYLSWGQALEEEEEGALLAQAGEKLEPSTTSTSQPHLIFILADDQGFRDVGYHGSEIKTPTLDKLAAEGVKLENYYVQPICTPSRSQFITGK

SEQ ID NO: 6624 - protein, 536 aa, Homo sapiens
  Payload ID: 1430;
  Gene Symbol: ARSK;
  Gene Name: arylsulfatase family, member K;
  Uniprot ID:  Q6UWY0;
  ENSP ID: ENSP00000369346
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSLLPLSSETFKNEHKVKNLHPPWILSEFHGCNVNASTYMLRTNHWKYIAYSDGASILPQLFDLSSDPDELTNVAVKFPEITYSLDQKLHSIINYPKVSASVHQYNKEQFIKWKQSIGQNYSNVIANLRWHQDWQKEPRKYENAIDQWLKTHMNPRAV

SEQ ID NO: 6625 - protein, 46 aa, Homo sapiens
  Payload ID: 1430;
  Gene Symbol: ARSK;
  Gene Name: arylsulfatase family, member K;
  ENSP ID: ENSP00000422126
MLLLWVSVVAALALAVLAPGAGEQRRRAAKAPNVVLVVSDSFIPDD

SEQ ID NO: 6626 - protein, 153 aa, Homo sapiens
  Payload ID: 1430;
  Gene Symbol: ARSK;
  Gene Name: arylsulfatase family, member K;
  ENSP ID: ENSP00000422608
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSIRHSERGSTNQRSEKV

SEQ ID NO: 6627 - protein, 395 aa, Homo sapiens
  Payload ID: 1430;
  Gene Symbol: ARSK;
  Gene Name: arylsulfatase family, member K;
  ENSP ID: ENSP00000423636
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDEKTEVEISKLLAEVHMASGILLEFLCLRT

SEQ ID NO: 6628 - protein, 92 aa, Homo sapiens
  Payload ID: 1430;
  Gene Symbol: ARSK;
  Gene Name: arylsulfatase family, member K;
  ENSP ID: ENSP00000424018
RAAKAPNVVLVVSDSFDGRLTFHPGSQVVKLPFINFMKTRGTSFLNAYTNSPICCPSRAVIVWKRGQEMLLSYSDKKAGPWLILSVTGLKSE

SEQ ID NO: 6629 - protein, 525 aa, Homo sapiens
  Payload ID: 1431;
  Gene Symbol: ARSG;
  Gene Name: arylsulfatase G;
  Uniprot ID:  Q96EG1;
  ENSP ID: ENSP00000407193
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 6630 - protein, 361 aa, Homo sapiens
  Payload ID: 1431;
  Gene Symbol: ARSG;
  Gene Name: arylsulfatase G;
  ENSP ID: ENSP00000413953
MGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 6631 - protein, 28 aa, Homo sapiens
  Payload ID: 1431;
  Gene Symbol: ARSG;
  Gene Name: arylsulfatase G;
  ENSP ID: ENSP00000462306
MGWLFLKVLLAGVSFSGFLYPLVDFCIS

SEQ ID NO: 6632 - protein, 525 aa, Homo sapiens; identical to SEQ ID NO: 6629
  Payload ID: 1431;
  Gene Symbol: ARSG;
  Gene Name: arylsulfatase G;
  Uniprot ID:  Q96EG1;
  ENSP ID: ENSP00000480910

SEQ ID NO: 6633 - protein, 2969 aa, Homo sapiens
  Payload ID: 1432;
  Gene Symbol: ASH1L;
  Gene Name: ash1 (absent, small, or homeotic)-like (Drosophila);
  Uniprot ID:  Q9NR48;
  ENSP ID: ENSP00000357330
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVTSDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVVFFVSGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKWSVNGVYRIGLYALKDMPAGTELTYDYNFHSFNVEKQQLCKCGFEKCRGIIGGKSQRVNGLTSSKNSQPMATHKKSGRSKEKRKSKHKLKKRRGHLSEEPSENINTPTRLTPQLQMKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNEKEERFAFGHHYFRPHETHHSPSRRFYHNELFRVPLYEIIPLEAVVGTCCVLDLYTYCKGRPKGVKEQDVYICDYRLDKSAHLFYKIHRNRYPVCTKPYAFDHFPKKLTPKKDFSPHYVPDNYKRNGGRSSWKSERSKPPLKDLGQEDDALPLIEEVLASQEQAANEIPSLEEPEREGATANVSEGEKKTEESSQEPQSTCTPEERRHNQRERLNQILLNLLEKIPGKNAIDVTYLLEEGSGRKLRRRTLFIPENSFRK

SEQ ID NO: 6634 - protein, 2964 aa, Homo sapiens
  Payload ID: 1432;
  Gene Symbol: ASH1L;
  Gene Name: ash1 (absent, small, or homeotic)-like (Drosophila);
  Uniprot ID:  Q9NR48;
  ENSP ID: ENSP00000376204
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVTSDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKWSVNGVYRIGLYALKDMPAGTELTYDYNFHSFNVEKQQLCKCGFEKCRGIIGGKSQRVNGLTSSKNSQPMATHKKSGRSKEKRKSKHKLKKRRGHLSEEPSENINTPTRLTPQLQMKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNEKEERFAFGHHYFRPHETHHSPSRRFYHNELFRVPLYEIIPLEAVVGTCCVLDLYTYCKGRPKGVKEQDVYICDYRLDKSAHLFYKIHRNRYPVCTKPYAFDHFPKKLTPKKDFSPHYVPDNYKRNGGRSSWKSERSKPPLKDLGQEDDALPLIEEVLASQEQAANEIPSLEEPEREGATANVSEGEKKTEESSQEPQSTCTPEERRHNQRERLNQILLNLLEKIPGKNAIDVTYLLEEGSGRKLRRRTLFIPENSFRK

SEQ ID NO: 6635 - protein, 154 aa, Homo sapiens
  Payload ID: 1432;
  Gene Symbol: ASH1L;
  Gene Name: ash1 (absent, small, or homeotic)-like (Drosophila);
  ENSP ID: ENSP00000448820
  MOD_RES (1)..(1): Any amino acid
XLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREYDQRENKILRNLWKEWHYIKLRFLAGHGRSCL

SEQ ID NO: 6636 - protein, 177 aa, Homo sapiens
  Payload ID: 1432;
  Gene Symbol: ASH1L;
  Gene Name: ash1 (absent, small, or homeotic)-like (Drosophila);
  ENSP ID: ENSP00000449283
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRMESYSVAQTGVQWCDLGSPQPPPPGFKRFSYSPASAP

SEQ ID NO: 6637 - protein, 628 aa, Homo sapiens
  Payload ID: 1433;
  Gene Symbol: ASH2L;
  Gene Name: ash2 (absent, small, or homeotic)-like (Drosophila);
  Uniprot ID:  Q9UBL3;
  ENSP ID: ENSP00000340896
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 6638 - protein, 534 aa, Homo sapiens
  Payload ID: 1433;
  Gene Symbol: ASH2L;
  Gene Name: ash2 (absent, small, or homeotic)-like (Drosophila);
  Uniprot ID:  Q9UBL3;
  ENSP ID: ENSP00000395310
MDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 6639 - protein, 90 aa, Homo sapiens
  Payload ID: 1433;
  Gene Symbol: ASH2L;
  Gene Name: ash2 (absent, small, or homeotic)-like (Drosophila);
  ENSP ID: ENSP00000427839
  MOD_RES (1)..(1): Any amino acid
XQIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 6640 - protein, 201 aa, Homo sapiens
  Payload ID: 1433;
  Gene Symbol: ASH2L;
  Gene Name: ash2 (absent, small, or homeotic)-like (Drosophila);
  ENSP ID: ENSP00000428877
MAAAGAGPGQEAGAGPGPGAVANATGAEEGEMKPVAAGAAAPPGEGISAAPTVEPSSGEAEGGKETTLQCQTGRSNGHSENRVGELPLFEPLPGPTLTQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHP

SEQ ID NO: 6641 - protein, 192 aa, Homo sapiens
  Payload ID: 1433;
  Gene Symbol: ASH2L;
  Gene Name: ash2 (absent, small, or homeotic)-like (Drosophila);
  ENSP ID: ENSP00000429387
  MOD_RES (1)..(1): Any amino acid
XGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPVSN

SEQ ID NO: 6642 - protein, 501 aa, Homo sapiens
  Payload ID: 1433;
  Gene Symbol: ASH2L;
  Gene Name: ash2 (absent, small, or homeotic)-like (Drosophila);
  Uniprot ID:  Q9UBL3;
  ENSP ID: ENSP00000430259
MDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEVSINFGPCFKYPPKDLTYRPMSDMGWGAVVEHTLADVLYHVETEVDGRRSPPWEP

SEQ ID NO: 6643 - protein, 121 aa, Homo sapiens
  Payload ID: 1433;
  Gene Symbol: ASH2L;
  Gene Name: ash2 (absent, small, or homeotic)-like (Drosophila);
  ENSP ID: ENSP00000430889
MAAAGAGPGQEAGAGPGPGAVANATGAEEGEMKPVAAGAAAPPGEGISAAPTVEPSSGEAEGGEANLVDVSGGLETESSNGKDTLILSTFHDQLQFSLQRLPSQWEYLFPPEASKLEGNVP

SEQ ID NO: 6644 - protein, 489 aa, Homo sapiens
  Payload ID: 1433;
  Gene Symbol: ASH2L;
  Gene Name: ash2 (absent, small, or homeotic)-like (Drosophila);
  ENSP ID: ENSP00000443606
MTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 6645 - protein, 291 aa, Homo sapiens
  Payload ID: 1434;
  Gene Symbol: ASGR1;
  Gene Name: asialoglycoprt receptor 1;
  Uniprot ID:  P07306;
  ENSP ID: ENSP00000269299
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 6646 - protein, 190 aa, Homo sapiens
  Payload ID: 1434;
  Gene Symbol: ASGR1;
  Gene Name: asialoglycoprt receptor 1;
  ENSP ID: ENSP00000370307
MKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 6647 - protein, 94 aa, Homo sapiens
  Payload ID: 1434;
  Gene Symbol: ASGR1;
  Gene Name: asialoglycoprt receptor 1;
  ENSP ID: ENSP00000458530
MAALQGNGSERTCCPVNWVEHERSCYWFSRSGKAWADADNYCRLEDAHLVVVTSWEEQKFVQHHIGPVNTWMGLHDQNGPWKWVDGTDYETGFK

SEQ ID NO: 6648 - protein, 29 aa, Homo sapiens
  Payload ID: 1434;
  Gene Symbol: ASGR1;
  Gene Name: asialoglycoprt receptor 1;
  ENSP ID: ENSP00000458803
MKSLESQLEKQQKDLSEDHSSLLLHVKQF

SEQ ID NO: 6649 - protein, 252 aa, Homo sapiens
  Payload ID: 1434;
  Gene Symbol: ASGR1;
  Gene Name: asialoglycoprt receptor 1;
  Uniprot ID:  P07306;
  ENSP ID: ENSP00000459169
MTKEYQDLQHLDNEESDHHQLRKDSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 6650 - protein, 117 aa, Homo sapiens
  Payload ID: 1434;
  Gene Symbol: ASGR1;
  Gene Name: asialoglycoprt receptor 1;
  ENSP ID: ENSP00000459896
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLS

SEQ ID NO: 6651 - protein, 162 aa, Homo sapiens
  Payload ID: 1434;
  Gene Symbol: ASGR1;
  Gene Name: asialoglycoprt receptor 1;
  ENSP ID: ENSP00000467511
  MOD_RES (1)..(1): Any amino acid
XRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFK

SEQ ID NO: 6652 - protein, 252 aa, Homo sapiens; identical to SEQ ID NO: 6649
  Payload ID: 1434;
  Gene Symbol: ASGR1;
  Gene Name: asialoglycoprt receptor 1;
  Uniprot ID:  P07306;
  ENSP ID: ENSP00000481182

SEQ ID NO: 6653 - protein, 287 aa, Homo sapiens
  Payload ID: 1435;
  Gene Symbol: ASGR2;
  Gene Name: asialoglycoprt receptor 2;
  Uniprot ID:  P07307;
  ENSP ID: ENSP00000254850
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 6654 - protein, 311 aa, Homo sapiens
  Payload ID: 1435;
  Gene Symbol: ASGR2;
  Gene Name: asialoglycoprt receptor 2;
  Uniprot ID:  P07307;
  ENSP ID: ENSP00000347140
MAKDFQDIQQLSSEENDHPFHQGEGPGTRRLNPRRGNPFLKGPPPAQPLAQRLCSMVCFSLLALSFNILLLVVICVTGSQSEGHGGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 6655 - protein, 292 aa, Homo sapiens
  Payload ID: 1435;
  Gene Symbol: ASGR2;
  Gene Name: asialoglycoprt receptor 2;
  Uniprot ID:  P07307;
  ENSP ID: ENSP00000405844
MAKDFQDIQQLSSEENDHPFHQGPPPAQPLAQRLCSMVCFSLLALSFNILLLVVICVTGSQSEGHGGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 6656 - protein, 135 aa, Homo sapiens
  Payload ID: 1435;
  Gene Symbol: ASGR2;
  Gene Name: asialoglycoprt receptor 2;
  ENSP ID: ENSP00000458835
MAKDFQDIQQLSSEENDHPFHQGEGPGTRRLNPRRGNPFLKGPPPAQPLAQRLCSMVCFSLLALSFNILLLVVICVTGSQSAQLQAELRSLKEAFSNFSSSTLTEVQAISTHGGSVGDKITSLGAKLEKQQQDLK

SEQ ID NO: 6657 - protein, 140 aa, Homo sapiens
  Payload ID: 1436;
  Gene Symbol: ASPG;
  Gene Name: asparaginase;
  ENSP ID: ENSP00000446856
AAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEPSCFQEVLPGV

SEQ ID NO: 6658 - protein, 126 aa, Homo sapiens
  Payload ID: 1436;
  Gene Symbol: ASPG;
  Gene Name: asparaginase;
  ENSP ID: ENSP00000447032
  MOD_RES (1)..(1): Any amino acid
XPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPELLTKDLRGEMTPPSVEER

SEQ ID NO: 6659 - protein, 555 aa, Homo sapiens
  Payload ID: 1436;
  Gene Symbol: ASPG;
  Gene Name: asparaginase;
  ENSP ID: ENSP00000448911
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRQRQPGTWQWWPFYRAWRVRLVPRPHAQKCCLVSNLKASCCSISHSFLP

SEQ ID NO: 6660 - protein, 573 aa, Homo sapiens
  Payload ID: 1436;
  Gene Symbol: ASPG;
  Gene Name: asparaginase;
  Uniprot ID:  Q86U10;
  ENSP ID: ENSP00000450040
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEVLPGV

SEQ ID NO: 6661 - protein, 308 aa, Homo sapiens
  Payload ID: 1437;
  Gene Symbol: ASRGL1;
  Gene Name: asparaginase like 1;
  Uniprot ID:  Q7L266;
  ENSP ID: ENSP00000301776
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQKNLGTVGAVALDCKGNVAYATSTGGIVNKMVGRVGDSPCLGAGGYADNDIGAVSTTGHGESILKVNLARLTLFHIEQGKTVEEAADLSLGYMKSRVKGLGGLIVVSKTGDWVAKWTSTSMPWAAAKDGKLHFGIDPDDTTITDLP

SEQ ID NO: 6662 - protein, 308 aa, Homo sapiens; identical to SEQ ID NO: 6661
  Payload ID: 1437;
  Gene Symbol: ASRGL1;
  Gene Name: asparaginase like 1;
  Uniprot ID:  Q7L266;
  ENSP ID: ENSP00000400057

SEQ ID NO: 6663 - protein, 70 aa, Homo sapiens
  Payload ID: 1437;
  Gene Symbol: ASRGL1;
  Gene Name: asparaginase like 1;
  ENSP ID: ENSP00000431772
MNPIVVVHGGGAGPISKDRKERVHQGMVRAATVGYGILREGGSAVDAVEGAVVALEDDPEFNADTSLLSD

SEQ ID NO: 6664 - protein, 70 aa, Homo sapiens; identical to SEQ ID NO: 6663
  Payload ID: 1437;
  Gene Symbol: ASRGL1;
  Gene Name: asparaginase like 1;
  ENSP ID: ENSP00000433136

SEQ ID NO: 6665 - protein, 164 aa, Homo sapiens
  Payload ID: 1437;
  Gene Symbol: ASRGL1;
  Gene Name: asparaginase like 1;
  ENSP ID: ENSP00000478649
MNPIVVVHGGGAGPISKDRKERVHQGMVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQKTDCQK

SEQ ID NO: 6666 - protein, 133 aa, Homo sapiens
  Payload ID: 1437;
  Gene Symbol: ASRGL1;
  Gene Name: asparaginase like 1;
  ENSP ID: ENSP00000482684
MVRAATVGYGILREGGSAVDAVEGAVVALEDDPEFNAGCGSVLNTNGEVEMDASIMDGKDLSAGAVSAVQCIANPIKLARLVMEKTPHCFLTDQGAAQFAAAMGVPEIPGEKLVTERNKKRLEKEKHEKGAQK

SEQ ID NO: 6667 - protein, 56 aa, Homo sapiens
  Payload ID: 1437;
  Gene Symbol: ASRGL1;
  Gene Name: asparaginase like 1;
  ENSP ID: ENSP00000484457
IPGEKLVTERNKKRLEKEKHEKGAQKTDCQKFFRGHKLTTRLTVDVLGNLSSTCSQ

SEQ ID NO: 6668 - protein, 70 aa, Homo sapiens; identical to SEQ ID NO: 6663
  Payload ID: 1437;
  Gene Symbol: ASRGL1;
  Gene Name: asparaginase like 1;
  ENSP ID: ENSP00000486943

SEQ ID NO: 6669 - protein, 561 aa, Homo sapiens
  Payload ID: 1438;
  Gene Symbol: ASNS;
  Gene Name: asparagine synthetase (glutamine-hydrolyzing);
  Uniprot ID:  P08243;
  ENSP ID: ENSP00000175506
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 6670 - protein, 561 aa, Homo sapiens; identical to SEQ ID NO: 6669
  Payload ID: 1438;
  Gene Symbol: ASNS;
  Gene Name: asparagine synthetase (glutamine-hydrolyzing);
  Uniprot ID:  P08243;
  ENSP ID: ENSP00000377845

SEQ ID NO: 6671 - protein, 561 aa, Homo sapiens; identical to SEQ ID NO: 6669
  Payload ID: 1438;
  Gene Symbol: ASNS;
  Gene Name: asparagine synthetase (glutamine-hydrolyzing);
  Uniprot ID:  P08243;
  ENSP ID: ENSP00000377846

SEQ ID NO: 6672 - protein, 162 aa, Homo sapiens
  Payload ID: 1438;
  Gene Symbol: ASNS;
  Gene Name: asparagine synthetase (glutamine-hydrolyzing);
  ENSP ID: ENSP00000394242
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAK

SEQ ID NO: 6673 - protein, 32 aa, Homo sapiens
  Payload ID: 1438;
  Gene Symbol: ASNS;
  Gene Name: asparagine synthetase (glutamine-hydrolyzing);
  ENSP ID: ENSP00000397802
MCGIWALFGSDDCLSVQCLSAMKIAHRGPDAF

SEQ ID NO: 6674 - protein, 214 aa, Homo sapiens
  Payload ID: 1438;
  Gene Symbol: ASNS;
  Gene Name: asparagine synthetase (glutamine-hydrolyzing);
  ENSP ID: ENSP00000400422
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHA

SEQ ID NO: 6675 - protein, 401 aa, Homo sapiens
  Payload ID: 1438;
  Gene Symbol: ASNS;
  Gene Name: asparagine synthetase (glutamine-hydrolyzing);
  ENSP ID: ENSP00000401651
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKDWRGRKKNCFVCQKQNSWCFCL

SEQ ID NO: 6676 - protein, 118 aa, Homo sapiens
  Payload ID: 1438;
  Gene Symbol: ASNS;
  Gene Name: asparagine synthetase (glutamine-hydrolyzing);
  ENSP ID: ENSP00000402350
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLD

SEQ ID NO: 6677 - protein, 540 aa, Homo sapiens
  Payload ID: 1438;
  Gene Symbol: ASNS;
  Gene Name: asparagine synthetase (glutamine-hydrolyzing);
  Uniprot ID:  P08243;
  ENSP ID: ENSP00000406994
MKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 6678 - protein, 478 aa, Homo sapiens
  Payload ID: 1438;
  Gene Symbol: ASNS;
  Gene Name: asparagine synthetase (glutamine-hydrolyzing);
  Uniprot ID:  P08243;
  ENSP ID: ENSP00000408472
MQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 6679 - protein, 63 aa, Homo sapiens
  Payload ID: 1438;
  Gene Symbol: ASNS;
  Gene Name: asparagine synthetase (glutamine-hydrolyzing);
  ENSP ID: ENSP00000408797
MKIAHRGPDAFRFENVNGYTNCCFGFHRLAVVDPLFGMQPIRVKKYPYLWLCYNGEIYNHKKV

SEQ ID NO: 6680 - protein, 28 aa, Homo sapiens
  Payload ID: 1438;
  Gene Symbol: ASNS;
  Gene Name: asparagine synthetase (glutamine-hydrolyzing);
  ENSP ID: ENSP00000413797
MCGIWALFGSDDCLSVQCLSAMKIAHRG

SEQ ID NO: 6681 - protein, 478 aa, Homo sapiens; identical to SEQ ID NO: 6678
  Payload ID: 1438;
  Gene Symbol: ASNS;
  Gene Name: asparagine synthetase (glutamine-hydrolyzing);
  Uniprot ID:  P08243;
  ENSP ID: ENSP00000414379

SEQ ID NO: 6682 - protein, 540 aa, Homo sapiens; identical to SEQ ID NO: 6677
  Payload ID: 1438;
  Gene Symbol: ASNS;
  Gene Name: asparagine synthetase (glutamine-hydrolyzing);
  Uniprot ID:  P08243;
  ENSP ID: ENSP00000414901

SEQ ID NO: 6683 - protein, 643 aa, Homo sapiens
  Payload ID: 1439;
  Gene Symbol: ASNSD1;
  Gene Name: asparagine synthetase domain containing 1;
  Uniprot ID:  Q9NWL6;
  ENSP ID: ENSP00000260952
MCGICCSVNFSAEHFSQDLKEDLLYNLKQRGPNSSKQLLKSDVNYQCLFSAHVLHLRGVLTTQPVEDERGNVFLWNGEIFSGIKVEAEENDTQILFNYLSSCKNESEILSLFSEVQGPWSFIYYQASSHYLWFGRDFFGRRSLLWHFSNLGKSFCLSSVGTQTSGLANQWQEVPASGLFRIDLKSTVISGCIILQLYPWKYISRENIIEENVNSLSQISADLPAFVSVVANEAKLYLEKPVVPLNMMLPQAALETHCSNISNVPPTREILQVFLTDVHMKEVIQQFIDVLSVAVKKRVLCLPRDENLTANEVLKTCDRKANVAILFSGGIDSMVIATLADRHIPLDEPIDLLNVAFIAEEKTMPTTFNREGNKQKNKCEIPSEEFSKDVAAAAADSPNKHVSVPDRITGRAGLKELQAVSPSRIWNFVEINVSMEELQKLRRTRICHLIRPLDTVLDDSIGCAVWFASRGIGWLVAQEGVKSYQSNAKVVLTGIGADEQLAGYSRHRVRFQSHGLEGLNKEIMMELGRISSRNLGRDDRVIGDHGKEARFPFLDENVVSFLNSLPIWEKANLTLPRGIGEKLLLRLAAVELGLTASALLPKRAMQFGSRIAKMEKINEKASDKCGRLQIMSLENLSIEKETKL

SEQ ID NO: 6684 - protein, 73 aa, Homo sapiens
  Payload ID: 1439;
  Gene Symbol: ASNSD1;
  Gene Name: asparagine synthetase domain containing 1;
  ENSP ID: ENSP00000398129
MCGICCSVNFSAEHFSQDLKEDLLYNLKQRGPNSSKQLLKSDVNYQCLFSAHVLHLRGVLTTQPVEDERGNVF

SEQ ID NO: 6685 - protein, 618 aa, Homo sapiens
  Payload ID: 1439;
  Gene Symbol: ASNSD1;
  Gene Name: asparagine synthetase domain containing 1;
  ENSP ID: ENSP00000406790
MCGICCSVNFSAEHFSQDLKEDLLYNLKQRGPNSSKQLLKSDVNYQCLFSAHVLHLRGVLTTQPVEDERGNVFLWNGEIFSGIKVEAEENDTQILFNYLSSCKNESEILSLFSEVQGPWSFIYYQASSHYLWFGRDFFGRRSLLWHFSNLGKSFCLSSVGTQTSGLANQWQEVPASGLFRIDLKSTVISGCIILQLYPWKYISRENIIEENVNSLSQISADLPAFVSVVANEAKLYLEKPVVPLNMMLPQAALETHCSNISNVPPTREILQVFLTDVHMKEVIQQFIDVLSVAVKKRVLCLPRDENLTANEVLKTCDRKANVAILFSGGIDSMVIATLADRHIPLDEPIDLLNVAFIAEEKTMPTTFNREGNKQKNKCEIPSEEFSKDVAAAAADSPNKHVSVPDRITGRAGLKELQAVSPSRIWNFVEINVSMEELQKLRRTRICHLIRPLDTVLDDSIGCAVWFASRGIGWLVAQEGVKSYQSNAKVVLTGIGADEQLAGYSRHRVRFQSHGLEGLNKEIMMELGRISSRNLGRDDRVIGDHGKEARFPFLDENVVSFLNSLPIWEKANLTLPRGIGEKLLLRLAAVELGLTASALLPKRAMQFGSRIAKMEKINE

SEQ ID NO: 6686 - protein, 96 aa, Homo sapiens
  Payload ID: 1439;
  Gene Symbol: ASNSD1;
  Gene Name: asparagine synthetase domain containing 1;
  ENSP ID: ENSP00000475224
MPSRGTRPEDSSVLIPTDNSTPHKEDLSSKIKEQKIVVDELSNLKKNRKVYRQQQNSNIFFLADRTEMLSESKNILDELKKEYQEIENLDKTKIKK

SEQ ID NO: 6687 - protein, 63 aa, Homo sapiens
  Payload ID: 1439;
  Gene Symbol: ASNSD1;
  Gene Name: asparagine synthetase domain containing 1;
  ENSP ID: ENSP00000475546
MPSRGTRPEDSSVLIPTDNSTPHKEDLSSKIKEQKIVVDELSNLKKNRTEQKCCLRARIYWMN

SEQ ID NO: 6688 - protein, 45 aa, Homo sapiens
  Payload ID: 1439;
  Gene Symbol: ASNSD1;
  Gene Name: asparagine synthetase domain containing 1;
  ENSP ID: ENSP00000475805
MPSRGTRPEDSSVLIPTDNSTPHKEDLSSKTEQKCCLRARIYWMN

SEQ ID NO: 6689 - protein, 162 aa, Homo sapiens
  Payload ID: 1439;
  Gene Symbol: ASNSD1;
  Gene Name: asparagine synthetase domain containing 1;
  ENSP ID: ENSP00000475970
MCGICCSVVLTGIGADEQLAGYSRHRVRFQSHGLEGLNKEIMMELGRISSRNLGRDDRVIGDHGKEARFPFLDENVVSFLNSLPIWEKANLTLPRGIGEKLLLRLAAVELGLTASALLPKRAMQFGSRIAKMEKINEKASDKCGRLQIMSLENLSIEKETKL

SEQ ID NO: 6690 - protein, 246 aa, Homo sapiens
  Payload ID: 1439;
  Gene Symbol: ASNSD1;
  Gene Name: asparagine synthetase domain containing 1;
  ENSP ID: ENSP00000476091
MPSRGTRPEDSSVLIPTDNSTPHKEDLSSKIKEQKIVVDELSNLKKNRKVYRQQQNSNIFFLADRTEMLSESKTFIAEEKTMPTTFNREGNKQKNKCEIPSEEFSKDVAAAAADSPNKHVSVPDRITGRAGLKELQAVSPSRIWNFVEINVSMEELQKLRRTRICHLIRPLDTVLDDSIGCAVWFASRGIGWLVAQEGVKSYQSNAKVVLTGIGADEQLAGYSRHRVRFQSHGLEGLNKEIMMELG

SEQ ID NO: 6691 - protein, 57 aa, Homo sapiens
  Payload ID: 1439;
  Gene Symbol: ASNSD1;
  Gene Name: asparagine synthetase domain containing 1;
  ENSP ID: ENSP00000476099
MPSRGTRPEDSSVLIPTDNSTPHKEDLSSKIKEQKIVVDELSNLKKNRPKLCFPESI

SEQ ID NO: 6692 - protein, 548 aa, Homo sapiens
  Payload ID: 1440;
  Gene Symbol: NARS;
  Gene Name: asparaginyl-tRNA synthetase;
  Uniprot ID:  O43776;
  ENSP ID: ENSP00000256854
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPGGHELSCDFWELIGLAPAGGADNLINEESDVDVQLNNRHMMIRGENMSKILKARSMVTRCFRDHFFDRGYYEVTPPTLVQTQVEGGATLFKLDYFGEEAFLTQSSQLYLETCLPALGDVFCIAQSYRAEQSRTRRHLAEYTHVEAECPFLTFDDLLNRLEDLVCDVVDRILKSPAGSIVHELNPNFQPPKRPFKRMNYSDAIVWLKEHDVKKEDGTFYEFGEDIPEAPERLMTDTINEPILLCRFPVEIKSFYMQRCPEDSRLTESVDVLMPNVGEIVGGSMRIFDSEEILAGYKREGIDPTPYYWYTDQRKYGTCPHGGYGLGLERFLTWILNRYHIRDVCLYPRFVQRCTP

SEQ ID NO: 6693 - protein, 174 aa, Homo sapiens
  Payload ID: 1440;
  Gene Symbol: NARS;
  Gene Name: asparaginyl-tRNA synthetase;
  Uniprot ID:  O43776;
  ENSP ID: ENSP00000442496
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQVSVLQWSSLVHGEQCCSVWNAKSYPKGQAGSRWP

SEQ ID NO: 6694 - protein, 162 aa, Homo sapiens
  Payload ID: 1440;
  Gene Symbol: NARS;
  Gene Name: asparaginyl-tRNA synthetase;
  ENSP ID: ENSP00000464899
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQVSVLQWSSLVHGEQCCSVWNAK

SEQ ID NO: 6695 - protein, 136 aa, Homo sapiens
  Payload ID: 1440;
  Gene Symbol: NARS;
  Gene Name: asparaginyl-tRNA synthetase;
  ENSP ID: ENSP00000464988
MVLAELYVSDREGSDATGDGTKEKPFKTGLKALMTVGKEPFPTIYVDSQKENERWNVISKSQLKNIKKMWHREQMKSESREKKEAEDSLRREKNLEEAKKITIKNDPSLPEPKCVKIGALEITSLIGGTMKLLLQH

SEQ ID NO: 6696 - protein, 128 aa, Homo sapiens
  Payload ID: 1440;
  Gene Symbol: NARS;
  Gene Name: asparaginyl-tRNA synthetase;
  ENSP ID: ENSP00000466606
MWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPG

SEQ ID NO: 6697 - protein, 47 aa, Homo sapiens
  Payload ID: 1440;
  Gene Symbol: NARS;
  Gene Name: asparaginyl-tRNA synthetase;
  ENSP ID: ENSP00000466919
MVLELYVSDREGSDATGDGTKEKPFKTGLKYCTMFKNCLFSPPYPRL

SEQ ID NO: 6698 - protein, 163 aa, Homo sapiens
  Payload ID: 1440;
  Gene Symbol: NARS;
  Gene Name: asparaginyl-tRNA synthetase;
  ENSP ID: ENSP00000467421
MTVGKEPFPTIYVDSQKENERWNVISKSQLKNIKKMWHREQMKSESREKKEAEDSLRREKNLEEAKKITIKNDPSLPEPKCVKIGALEGYRGQRVKVFGWVHRLRRQGKNLMFLVLRDGTGYLQCVLADELCQCYNGVLLSTESSVAVYGMLNLTPKGKQAPG

SEQ ID NO: 6699 - protein, 167 aa, Homo sapiens
  Payload ID: 1440;
  Gene Symbol: NARS;
  Gene Name: asparaginyl-tRNA synthetase;
  ENSP ID: ENSP00000467651
MVLAELYVSDREGSDATGDGTKEKPFKTGLKALMTVGKEPFPTIYVDSQKENERWNVISKSQLKNIKKMWHREQMKSESREKKEVKIGALEGYRGQRVKVFGWVHRLRRQGKNLMFLVLRDGTGYLQCVLADELCQCYNGVLLSTESSVAVYGMLNLTPKGKQAPGG

SEQ ID NO: 6700 - protein, 477 aa, Homo sapiens
  Payload ID: 1441;
  Gene Symbol: NARS2;
  Gene Name: asparaginyl-tRNA synthetase 2, mitochondrial (putative);
  Uniprot ID:  Q96I59;
  ENSP ID: ENSP00000281038
MLGVRCLLRSVRFCSSAPFPKHKPSAKLSVRDALGAQNASGERIKIQGWIRSVRSQKEVLFLHVNDGSSLESLQVVADSGLDSRELNFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 6701 - protein, 241 aa, Homo sapiens
  Payload ID: 1441;
  Gene Symbol: NARS2;
  Gene Name: asparaginyl-tRNA synthetase 2, mitochondrial (putative);
  ENSP ID: ENSP00000432240
MLGVRCLLRSVRFCSSAPFPKHKPSAKLSVRDALGAQNASGERIKIQGWIRSVRSQKEVLFLHVNDGSSLESLQVVADSGLDSRELNFGSSVEVQGQLIKSPSKRQNVELKAEKIKVIGNCDAKDFPIKYKERHPLEYLRQYPHFRCRTNVLGSILRIRSEATAAIHSFFKDSGFVHIHTPIITSNDSEGAGELFQLEWGADLRTEHEKYLVKHCGNIPVFVINYPLTLKPFYMRDNEDGP

SEQ ID NO: 6702 - protein, 250 aa, Homo sapiens
  Payload ID: 1441;
  Gene Symbol: NARS2;
  Gene Name: asparaginyl-tRNA synthetase 2, mitochondrial (putative);
  Uniprot ID:  Q96I59;
  ENSP ID: ENSP00000432635
MSGAFTQVFTFGPTFRAENSQSRRHLAEFYMIEAEISFVDSLQDLMQVIEELFKATTMMVLSKCPEDVELCHKFIAPGQKDRLEHMLKNNFLIISYTEAVEILKQASQNFTFTPEWGADLRTEHEKYLVKHCGNIPVFVINYPLTLKPFYMRDNEDGPQHTVAAVDLLVPGVGELFGGGLREERYHFLEERLARSGLTEVYQWYLDLRRFGSVPHGGFGMGFERYLQCILGVDNIKDVIPFPRFPHSCLL

SEQ ID NO: 6703 - protein, 2 aa, Homo sapiens
  Payload ID: 1441;
  Gene Symbol: NARS2;
  Gene Name: asparaginyl-tRNA synthetase 2, mitochondrial (putative);
  ENSP ID: ENSP00000433478
MS

SEQ ID NO: 6704 - protein, 81 aa, Homo sapiens
  Payload ID: 1441;
  Gene Symbol: NARS2;
  Gene Name: asparaginyl-tRNA synthetase 2, mitochondrial (putative);
  ENSP ID: ENSP00000435298
  MOD_RES (1)..(1): Any amino acid
XVAAVDLLVPGVGELFGGGLREERYHFLEERLARYLDLRRFGSVPHGGFGMGFERYLQCILGVDNIKDVIPFPRFPHSCLL

SEQ ID NO: 6705 - protein, 106 aa, Homo sapiens
  Payload ID: 1441;
  Gene Symbol: NARS2;
  Gene Name: asparaginyl-tRNA synthetase 2, mitochondrial (putative);
  ENSP ID: ENSP00000436114
  MOD_RES (1)..(1): Any amino acid
XPIKYKERHPLEYLRQYPHFRCRTNVLGSILRIRSEATAAIHSFFKDSGFVHIHTPIITSNDSEGAGELFQLEPSGKLKVPEENFFNVPAFLTVSGQLHLEVMSGL

SEQ ID NO: 6706 - protein, 313 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000348841
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 6707 - protein, 203 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000368762
MAQRKNAKSSGNSSSSGSGSGSTSAGSSSPGARRETKHGGHKNGRKGGLSGTSFFTWFMVIALLGVWTSVAVVWFDLVDYEEVLAKAKDFRYNLSEVLQGKLGIYDADGDGDFDVDDAKVLLGLTKDGSNENIDSLEEVLNILAEESSDWFYGFLSFLYDIMTPFEMLEEEEEESETADGVDGTSQNEGVQGKTCVILDLHNQ

SEQ ID NO: 6708 - protein, 758 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000368767
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 6709 - protein, 225 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000373856
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 6710 - protein, 294 aa, Homo sapiens
  Payload ID: 1442;
  Gene Symbol: ASPH;
  Gene Name: aspartate beta-hydroxylase;
  ENSP ID: ENSP00000394013
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETDSSEPVVEDERLHHDTDDVTYQVYEEQAVYEPLENEGIEITEVTAPPEDNPVEDSQVIVEEVSIFPVEEQQEVPPDT

SEQ ID NO: 6711 - protein, 327 aa, Homo sapiens
  Payload ID: 1442;
  Gene Symbol: ASPH;
  Gene Name: aspartate beta-hydroxylase;
  ENSP ID: ENSP00000427823
MAQRKNAKSSGNSSSSGSGSGSTSAGSSSPGARRETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQVYEPLENEGIEITEVTAPPEDNPVEDSQVIVEEVSIFPVEEQQEVPPDT

SEQ ID NO: 6712 - protein, 198 aa, Homo sapiens
  Payload ID: 1442;
  Gene Symbol: ASPH;
  Gene Name: aspartate beta-hydroxylase;
  ENSP ID: ENSP00000427877
MAEDKETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHETEHSYHVEETDSSEPVVEDERLHHDTDDVTYQVYEEQAVYEPLENEGIEITEVTAPPEDNPVE

SEQ ID NO: 6713 - protein, 174 aa, Homo sapiens
  Payload ID: 1442;
  Gene Symbol: ASPH;
  Gene Name: aspartate beta-hydroxylase;
  ENSP ID: ENSP00000428060
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLTKDGSNENIDSLEEVLNILAEESSDWFYGFLSFLYDIMTPFEMLEEEEEESETADGVDGTSQNEGVQGKTCVILDLHNQ

SEQ ID NO: 6714 - protein, 256 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000429160
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 6715 - protein, 270 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000429286
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 6716 - protein, 136 aa, Homo sapiens
  Payload ID: 1442;
  Gene Symbol: ASPH;
  Gene Name: aspartate beta-hydroxylase;
  ENSP ID: ENSP00000429718
MAEDKETKHGGHKNGRKGGLSGTSFFTWFMVIALLGVWTSVAVVWFDLVDYEEVLGKLGIYDADGDGDFDVDDAKVLLVKKKKPKLLNKFDKTIKAELDAAEKLRKRGKIEEAVNAFKELVRKYPQSPRARYGKAQ

SEQ ID NO: 6717 - protein, 113 aa, Homo sapiens
  Payload ID: 1442;
  Gene Symbol: ASPH;
  Gene Name: aspartate beta-hydroxylase;
  ENSP ID: ENSP00000429743
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGNLHCI

SEQ ID NO: 6718 - protein, 299 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000429954
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPDT

SEQ ID NO: 6719 - protein, 298 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000430245
MAEDKETKHGGHKNGRKGGLSGTSFFTWFMVIALLGVWTSVAVVWFDLVDYEEVLAKAKDFRYNLSEVLQGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQVYEPLENEGIEITEVTAPPEDNPVEDSQVIVEEVSIFPVEEQQEVPPDT

SEQ ID NO: 6720 - protein, 163 aa, Homo sapiens
  Payload ID: 1442;
  Gene Symbol: ASPH;
  Gene Name: aspartate beta-hydroxylase;
  ENSP ID: ENSP00000430516
MATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKEDSFASGESQAACTMSWDFSHPFMC

SEQ ID NO: 6721 - protein, 210 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000436188
MAEDKETKHGGHKNGRKGGLSGTSFFTWFMVIALLGVWTSVAVVWFDLVDYEEVLGKLGIYDADGDGDFDVDDAKVLLEGPSGVAKRKTKAKVKELTKEELKKEKEKPESRKESKNEERKKGKKEDVRKDKKIADADLSRKESPKGKKDREKEKVDLEKSAKTKENRKKSTNMKDVSSKMASRDKDDRKESRSSTRYAHLTKGNTQKRNG

SEQ ID NO: 6722 - protein, 729 aa, Homo sapiens
  Payload ID: 1442;
  Gene Symbol: ASPH;
  Gene Name: aspartate beta-hydroxylase;
  Uniprot ID:  Q12797;
  ENSP ID: ENSP00000437864
MAEDKETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 6723 - protein, 186 aa, Homo sapiens
  Payload ID: 1442;
  Gene Symbol: ASPH;
  Gene Name: aspartate beta-hydroxylase;
  ENSP ID: ENSP00000478706
  MOD_RES (1)..(1): Any amino acid
XFDVDDAKVLLGLKERSTSEPAVPPEEAEPHTEPEEQVPVEAEPQNIEDEAKEQIQSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEVKKKKPKLLNKFDKTIKAELDAAEKLRKR

SEQ ID NO: 6724 - protein, 44 aa, Homo sapiens
  Payload ID: 1442;
  Gene Symbol: ASPH;
  Gene Name: aspartate beta-hydroxylase;
  ENSP ID: ENSP00000479830
EDNPVEDSQVIVEEVSIFPVEEQQEVPPGYLMENMESELPWDES

SEQ ID NO: 6725 - protein, 195 aa, Homo sapiens
  Payload ID: 1442;
  Gene Symbol: ASPH;
  Gene Name: aspartate beta-hydroxylase;
  ENSP ID: ENSP00000479945
QSLLHEMVHAEHETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPVKKKKPKLLNKFDKTIKAELDAAEKLRKRGKIEEAVNAFKELVRKYPQSPRARYGKAQCEDDLAEKRRSNEVLRGAIE

SEQ ID NO: 6726 - protein, 134 aa, Homo sapiens
  Payload ID: 1442;
  Gene Symbol: ASPH;
  Gene Name: aspartate beta-hydroxylase;
  ENSP ID: ENSP00000483443
  MOD_RES (1)..(1): Any amino acid
XEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQEVTAPPEDNPVEDSQVIVEEVSIFPVEEQQEVPPDT

SEQ ID NO: 6727 - protein, 390 aa, Homo sapiens
  Payload ID: 1443;
  Gene Symbol: ASPHD1;
  Gene Name: aspartate beta-hydroxylase domain containing 1;
  Uniprot ID:  Q5U4P2;
  ENSP ID: ENSP00000311447
MKEGRGSFSVERGPRKERETAQSGMWKGNSPAGSQGAAMEGTGGELGGQGNWGPEDAPGLLARASLIMLPWPLPLASSALTLLFGALTSLFLWYCYRLGSQDMQALGAGSRAGGVRGGPVGCSEAGGPSPGGPGDPGEGPRTEGLVSRRLRAYARRYSWAGMGRVRRAAQGGPGPGRGPGVLGIQRPGLLFLPDLPSAPFVPRDAQRHDVELLESSFPAILRDFGAVSWDFSGTTPPPRGWSPPLAPGCYQLLLYQAGRCQPSNCRRCPGAYRALRGLRSFMSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFAPDP

SEQ ID NO: 6728 - protein, 390 aa, Homo sapiens; identical to SEQ ID NO: 6727
  Payload ID: 1443;
  Gene Symbol: ASPHD1;
  Gene Name: aspartate beta-hydroxylase domain containing 1;
  Uniprot ID:  Q5U4P2;
  ENSP ID: ENSP00000388036

SEQ ID NO: 6729 - protein, 390 aa, Homo sapiens; identical to SEQ ID NO: 6727
  Payload ID: 1443;
  Gene Symbol: ASPHD1;
  Gene Name: aspartate beta-hydroxylase domain containing 1;
  Uniprot ID:  Q5U4P2;
  ENSP ID: ENSP00000456801

SEQ ID NO: 6730 - protein, 109 aa, Homo sapiens
  Payload ID: 1443;
  Gene Symbol: ASPHD1;
  Gene Name: aspartate beta-hydroxylase domain containing 1;
  ENSP ID: ENSP00000459527
MSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFAPDP

SEQ ID NO: 6731 - protein, 106 aa, Homo sapiens
  Payload ID: 1443;
  Gene Symbol: ASPHD1;
  Gene Name: aspartate beta-hydroxylase domain containing 1;
  ENSP ID: ENSP00000460020
MSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFA

SEQ ID NO: 6732 - protein, 369 aa, Homo sapiens
  Payload ID: 1444;
  Gene Symbol: ASPHD2;
  Gene Name: aspartate beta-hydroxylase domain containing 2;
  Uniprot ID:  Q6ICH7;
  ENSP ID: ENSP00000215906
MVWAPLGPPRTDCLTLLHTPSKDSPKMSLEWLVAWSWSLDGLRDCIATGIQSVRDCDTTAVITVACLLVLFVWYCYHVGREQPRPYVSVNSLMQAADANGLQNGYVYCQSPECVRCTHNEGLNQKLYHNLQEYAKRYSWSGMGRIHKGIREQGRYLNSRPSIQKPEVFFLPDLPTTPYFSRDAQKHDVEVLERNFQTILCEFETLYKAFSNCSLPQGWKMNSTPSGEWFTFYLVNQGVCVPRNCRKCPRTYRLLGSLRTCIGNNVFGNACISVLSPGTVITEHYGPTNIRIRCHLGLKTPNGCELVVGGEPQCWAEGRCLLFDDSFLHAAFHEGSAEDGPRVVFMVDLWHPNVAAAERQALDFIFAPGR

SEQ ID NO: 6733 - protein, 178 aa, Homo sapiens
  Payload ID: 1445;
  Gene Symbol: ASPDH;
  Gene Name: aspartate dehydrogenase domain containing;
  Uniprot ID:  A6ND91;
  ENSP ID: ENSP00000366114
MGDRVKGSKSRRPDLVVEVAHPKIIHESGAQILRHANLLSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWQSLLACCQLPSRPGIHLC

SEQ ID NO: 6734 - protein, 283 aa, Homo sapiens
  Payload ID: 1445;
  Gene Symbol: ASPDH;
  Gene Name: aspartate dehydrogenase domain containing;
  Uniprot ID:  A6ND91;
  ENSP ID: ENSP00000373860
MADRGPWRVGVVGYGRLGQSLVSRLLAQGPELGLELVFVWNRDPGRMAGSVPPSLQLQNLAALGERRPDLVVEVAHPKIIHESGAQILRHANLLVGSPSALSDQTTERQLLEASQHWDHAVFVARGALWGAEDIRRLDAAGGLRSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWQSLLACCQLPSRPGIHLC

SEQ ID NO: 6735 - protein, 51 aa, Homo sapiens
  Payload ID: 1445;
  Gene Symbol: ASPDH;
  Gene Name: aspartate dehydrogenase domain containing;
  ENSP ID: ENSP00000469754
MGDRVKGSKSRRPDLVVEVAHPKIIHESGAQILRHANLLVGSPSALSDQTT

SEQ ID NO: 6736 - protein, 134 aa, Homo sapiens
  Payload ID: 1445;
  Gene Symbol: ASPDH;
  Gene Name: aspartate dehydrogenase domain containing;
  ENSP ID: ENSP00000470360
MATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWQSLLACCQLPSRPGIHLC

SEQ ID NO: 6737 - protein, 229 aa, Homo sapiens
  Payload ID: 1446;
  Gene Symbol: DRICH1;
  Gene Name: aspartate-rich 1;
  Uniprot ID:  Q6PGQ1;
  ENSP ID: ENSP00000316137
MGNILTCCINSHCGWPRGKDAPCYESDTDIYETVAAATSESTTVEPGKLDVGATEGQDLQHISNQKMPTGPPEDRLSLKFLPSSEEDNDDAKILPSPVQGSSEDNLSLVCLPRSEDDDCDDDDDDDAQILPSRVQGGCYRFDSSSCSSEDNLSLVCLPRSEDDDCDDDDDDAQILPSPVQACSEDSLFLRCSLRHKDEEEEDDDDIHITARIESDLTLESLSDEEIHPG

SEQ ID NO: 6738 - protein, 229 aa, Homo sapiens; identical to SEQ ID NO: 6737
  Payload ID: 1446;
  Gene Symbol: DRICH1;
  Gene Name: aspartate-rich 1;
  Uniprot ID:  Q6PGQ1;
  ENSP ID: ENSP00000483208

SEQ ID NO: 6739 - protein, 343 aa, Homo sapiens
  Payload ID: 1447;
  Gene Symbol: ASPRV1;
  Gene Name: aspartic peptidase, retroviral-like 1;
  Uniprot ID:  Q53RT3;
  ENSP ID: ENSP00000315383
MGSPGASLGIKKALQSEQATALPASAPAVSQPTAPAPSCLPKAGQVIPTLLREAPFSSVIAPTLLCGFLFLAWVAAEVPEESSRMAGSGARSEEGRRQHAFVPEPFDGANVVPNLWLHSFEVINDLNHWDHITKLRFLKESLRGEALGVYNRLSPQDQGDYGTVKEALLKAFGVPGAAPSHLPKEIVFANSMGKGYYLKGKIGKVPVRFLVDSGAQVSVVHPNLWEEVTDGDLDTLQPFENVVKVANGAEMKILGVWDTAVSLGKLKLKAQFLVANASAEEAIIGTDVLQDHNAILDFEHRTCTLKGKKFRLLPVGGSLEDEFDLELIEEDPSSEEGRQELSH

SEQ ID NO: 6740 - protein, 313 aa, Homo sapiens
  Payload ID: 1448;
  Gene Symbol: ASPA;
  Gene Name: aspartoacylase;
  Uniprot ID:  P45381;
  ENSP ID: ENSP00000263080
MTSCHIAEEHIQKVAIFGGTHGNELTGVFLVKHWLENGAEIQRTGLEVKPFITNPRAVKKCTRYIDCDLNRIFDLENLGKKMSEDLPYEVRRAQEINHLFGPKDSEDSYDIIFDLHNTTSNMGCTLILEDSRNNFLIQMFHYIKTSLAPLPCYVYLIEHPSLKYATTRSIAKYPVGIEVGPQPQGVLRADILDQMRKMIKHALDFIHHFNEGKEFPPCAIEVYKIIEKVDYPRDENGEIAAIIHPNLQDQDWKPLHPGDPMFLTLDGKTIPLGGDCTVYPVFVNEAAYYEKKEAFAKTTKLTLNAKSIRCCLH

SEQ ID NO: 6741 - protein, 313 aa, Homo sapiens; identical to SEQ ID NO: 6740
  Payload ID: 1448;
  Gene Symbol: ASPA;
  Gene Name: aspartoacylase;
  Uniprot ID:  P45381;
  ENSP ID: ENSP00000409976

SEQ ID NO: 6742 - protein, 78 aa, Homo sapiens
  Payload ID: 1448;
  Gene Symbol: ASPA;
  Gene Name: aspartoacylase;
  ENSP ID: ENSP00000458324
MTSCHIAEEHIQKVAIFGGTHGNELTGVFLVKHWLENGAEIQRTGLEVKPFITNPRAVKKCTRYIDCDLNRIFDLENL

SEQ ID NO: 6743 - protein, 56 aa, Homo sapiens
  Payload ID: 1448;
  Gene Symbol: ASPA;
  Gene Name: aspartoacylase;
  ENSP ID: ENSP00000461358
MTSCHIAEEHIQKVAIFGGTHGNELTGVFLVKHWLENGAEIQRTGLEQKNVRRFAI

SEQ ID NO: 6744 - protein, 485 aa, Homo sapiens [sequence omitted]

SEQ ID NO: 6745 - protein, 270 aa, Homo sapiens
  Payload ID: 1449;
  Gene Symbol: DNPEP;
  Gene Name: aspartyl aminopeptidase;
  ENSP ID: ENSP00000317252
MSGHSPTRGAMQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLCALLAIPPQPTSPHRVPILATAIQEELEKGTPEPGPLNAVDERHHSVLMSLLCAHLGLSPKDIVEMELCLADT

SEQ ID NO: 6746 - protein, 47 aa, Homo sapiens
  Payload ID: 1449;
  Gene Symbol: DNPEP;
  Gene Name: aspartyl aminopeptidase;
  ENSP ID: ENSP00000363074
MSGHSPTRGAMQVAMNGKARKEAVQTAAKELLKFVNRSPSPFHGWLQ

SEQ ID NO: 6747 - protein, 36 aa, Homo sapiens
  Payload ID: 1449;
  Gene Symbol: DNPEP;
  Gene Name: aspartyl aminopeptidase;
  ENSP ID: ENSP00000363077
MSGHSPTRGAMQVSGSRRPHLNFDPRPGPAPSGAQA

SEQ ID NO: 6748 - protein, 410 aa, Homo sapiens
  Payload ID: 1449;
  Gene Symbol: DNPEP;
  Gene Name: aspartyl aminopeptidase;
  ENSP ID: ENSP00000363083
MTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 6749 - protein, 273 aa, Homo sapiens
  Payload ID: 1449;
  Gene Symbol: DNPEP;
  Gene Name: aspartyl aminopeptidase;
  ENSP ID: ENSP00000400944
MNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALI

SEQ ID NO: 6750 - protein, 331 aa, Homo sapiens
  Payload ID: 1449;
  Gene Symbol: DNPEP;
  Gene Name: aspartyl aminopeptidase;
  ENSP ID: ENSP00000410684
MARSLSIMFVPNSWLNGYHKVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAH

SEQ ID NO: 6751 - protein, 137 aa, Homo sapiens
  Payload ID: 1449;
  Gene Symbol: DNPEP;
  Gene Name: aspartyl aminopeptidase;
  ENSP ID: ENSP00000412003
MTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKG

SEQ ID NO: 6752 - protein, 117 aa, Homo sapiens
  Payload ID: 1449;
  Gene Symbol: DNPEP;
  Gene Name: aspartyl aminopeptidase;
  ENSP ID: ENSP00000414739
MTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPN

SEQ ID NO: 6753 - protein, 45 aa, Homo sapiens
  Payload ID: 1449;
  Gene Symbol: DNPEP;
  Gene Name: aspartyl aminopeptidase;
  ENSP ID: ENSP00000428531
MARSLSIMFVPNSWLNGYHKHLLKVEIPGPQPKSSKSGVSGGHER

SEQ ID NO: 6754 - protein, 36 aa, Homo sapiens; identical to SEQ ID NO: 6747
  Payload ID: 1449;
  Gene Symbol: DNPEP;
  Gene Name: aspartyl aminopeptidase;
  ENSP ID: ENSP00000429468

SEQ ID NO: 6755 - protein, 224 aa, Homo sapiens
  Payload ID: 1449;
  Gene Symbol: DNPEP;
  Gene Name: aspartyl aminopeptidase;
  ENSP ID: ENSP00000429960
MSGHSPTRGAMQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLSWVVPMMSSSLLLGWTICTAASVPCRP

SEQ ID NO: 6756 - protein, 89 aa, Homo sapiens
  Payload ID: 1449;
  Gene Symbol: DNPEP;
  Gene Name: aspartyl aminopeptidase;
  ENSP ID: ENSP00000430630
MNGKARKEAVQTAAKELLKFVNRSPSPFHAVAECRNRLLQAGFSELKETEKWNIKPESKYFMTRNSSTIIAFAVGGQYVPGNGFSLIGA

SEQ ID NO: 6757 - protein, 493 aa, Homo sapiens
  Payload ID: 1449;
  Gene Symbol: DNPEP;
  Gene Name: aspartyl aminopeptidase;
  ENSP ID: ENSP00000431076
MARSLSIMFVPNSWLNGYHKVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 6758 - protein, 346 aa, Homo sapiens
  Payload ID: 1450;
  Gene Symbol: AGA;
  Gene Name: aspartylglucosaminidase;
  Uniprot ID:  P20933;
  ENSP ID: ENSP00000264595
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 6759 - protein, 138 aa, Homo sapiens
  Payload ID: 1450;
  Gene Symbol: AGA;
  Gene Name: aspartylglucosaminidase;
  ENSP ID: ENSP00000421471
  MOD_RES (1)..(1): Any amino acid
XGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGDSPIPGAGAYADD

SEQ ID NO: 6760 - protein, 154 aa, Homo sapiens
  Payload ID: 1450;
  Gene Symbol: AGA;
  Gene Name: aspartylglucosaminidase;
  ENSP ID: ENSP00000423798
RKVLEHTTHTLLVGESATTFAQSMGFINEDLSTTASQALHSDWLARNCQPNYWRNVIPDPSKYCGPYKPPGILKQDIPIHKETEDDRGHDTIGDSPIPGAGAYADDTAGAAAATGNGDILMRFLPSYQAVEYMRRGEDPTIACQKVISRIQKHF

SEQ ID NO: 6761 - protein, 501 aa, Homo sapiens
  Payload ID: 1451;
  Gene Symbol: DARS;
  Gene Name: aspartyl-tRNA synthetase;
  Uniprot ID:  P14868;
  ENSP ID: ENSP00000264161
MPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 6762 - protein, 188 aa, Homo sapiens
  Payload ID: 1451;
  Gene Symbol: DARS;
  Gene Name: aspartyl-tRNA synthetase;
  ENSP ID: ENSP00000387508
VGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 6763 - protein, 135 aa, Homo sapiens
  Payload ID: 1451;
  Gene Symbol: DARS;
  Gene Name: aspartyl-tRNA synthetase;
  ENSP ID: ENSP00000388801
MIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEE

SEQ ID NO: 6764 - protein, 182 aa, Homo sapiens
  Payload ID: 1451;
  Gene Symbol: DARS;
  Gene Name: aspartyl-tRNA synthetase;
  ENSP ID: ENSP00000389867
MIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGF

SEQ ID NO: 6765 - protein, 175 aa, Homo sapiens
  Payload ID: 1451;
  Gene Symbol: DARS;
  Gene Name: aspartyl-tRNA synthetase;
  ENSP ID: ENSP00000397616
MIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRE

SEQ ID NO: 6766 - protein, 179 aa, Homo sapiens
  Payload ID: 1451;
  Gene Symbol: DARS;
  Gene Name: aspartyl-tRNA synthetase;
  ENSP ID: ENSP00000404445
  MOD_RES (1)..(1): Any amino acid
XGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKVSFFKI

SEQ ID NO: 6767 - protein, 645 aa, Homo sapiens
  Payload ID: 1452;
  Gene Symbol: DARS2;
  Gene Name: aspartyl-tRNA synthetase 2, mitochondrial;
  Uniprot ID:  Q6PI48;
  ENSP ID: ENSP00000355086
MYFPSWLSQLYRGLSRPIRRTTQPIWGSLYRSLLQSSQRRIPEFSSFVVRTNTCGELRSSHLGQEVTLCGWIQYRRQNTFLVLRDFDGLVQVIIPQDESAASVKKILCEAPVESVVQVSGTVISRPAGQENPKMPTGEIEIKVKTAELLNACKKLPFEIKNFVKKTEALRLQYRYLDLRSFQMQYNLRLRSQMVMKMREYLCNLHGFVDIETPTLFKRTPGGAKEFLVPSREPGKFYSLPQSPQQFKQLLMVGGLDRYFQVARCYRDEGSRPDRQPEFTQIDIEMSFVDQTGIQSLIEGLLQYSWPNDKDPVVVPFPTMTFAEVLATYGTDKPDTRFGMKIIDISDVFRNTEIGFLQDALSKPHGTVKAICIPEGAKYLKRKDIESIRNFAADHFNQEILPVFLNANRNWNSPVANFIMESQRLELIRLMETQEEDVVLLTAGEHNKACSLLGKLRLECADLLETRGVVLRDPTLFSFLWVVDFPLFLPKEENPRELESAHHPFTAPHPSDIHLLYTEPKKARSQHYDLVLNGNEIGGGSIRIHNAELQRYILATLLKEDVKMLSHLLQALDYGAPPHGGIALGLDRLICLVTGSPSIRDVIAFPKSFRGHDLMSNTPDSVPPEELKPYHIRVSKPTDSKAERAH

SEQ ID NO: 6768 - protein, 243 aa, Homo sapiens
  Payload ID: 1453;
  Gene Symbol: ASPN;
  Gene Name: asporin;
  ENSP ID: ENSP00000364693
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKDNLPSF

SEQ ID NO: 6769 - protein, 380 aa, Homo sapiens
  Payload ID: 1453;
  Gene Symbol: ASPN;
  Gene Name: asporin;
  Uniprot ID:  Q9BXN1;
  ENSP ID: ENSP00000364694
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKGLPPTLLELHLDYNKISTVELEDFKRYKELQRLGLGNNKITDIENGSLANIPRVREIHLENNKLKKIPSGLPELKYLQIIFLHSNSIARVGVNDFCPTVPKMKKSLYSAISLFNNPVKYWEMQPATFRCVLSRMSVQLGNFGM

SEQ ID NO: 6770 - protein, 431 aa, Homo sapiens
  Payload ID: 1454;
  Gene Symbol: ASTL;
  Gene Name: astacin-like metallo-endopeptidase (M12 family);
  Uniprot ID:  Q6HA08;
  ENSP ID: ENSP00000343674
MEGVGGLWPWVLGLLSLPGVILGAPLASSCAGACGTSFPDGLTPEGTQASGDKDIPAINQGLILEETPESSFLIEGDIIRPSPFRLLSATSNKWPMGGSGVVEVPFLLSSKYDEPSRQVILEALAEFERSTCIRFVTYQDQRDFISIIPMYGCFSSVGRSGGMQVVSLAPTCLQKGRGIVLHELMHVLGFWHEHTRADRDRYIRVNWNEILPGFEINFIKSQSSNMLTPYDYSSVMHYGRLAFSRRGLPTITPLWAPSVHIGQRWNLSASDITRVLKLYGCSPSGPRPRGRGSHAHSTGRSPAPASLSLQRLLEALSAESRSPDPSGSSAGGQPVPAGPGESPHGWESPALKKLSAEASARQPQTLASSPRSRPGAGAPGVAQEQSWLAGVSTKPTVPSSEAGIQPVPVQGSPALPGGCVPRNHFKGMSED

SEQ ID NO: 6771 - protein, 679 aa, Homo sapiens
  Payload ID: 1455;
  Gene Symbol: ASTE1;
  Gene Name: asteroid homolog 1 (Drosophila);
  Uniprot ID:  Q2TB18;
  ENSP ID: ENSP00000264992
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQVKLQDFFQCGTYVCPDALNLGLPEWVLVALAKGQLSPFISDALVLRRTILPTQVENMQQPNAHRISQPIRQIIYGLLLNASPHLDKTSWNALPPQPLAFSEVERINKNIRTSIIDAVELAKDHSDLSRLTELSLRRRQMLLLETLKVKQTILEPIPTSLKLPIAVSCYWLQHTETKAKLHHLQSLLLTMLVGPLIAIINSPGKEELQEDGAKMLYAEFQRVKAQTRLGTRLDLDTAHIFCQWQSCLQMGMYLNQLLSTPLPEPDLTRLYSGSLVHGLCQQLLASTSVESLLSICPEAKQLYEYLFNATRSYAPAEIFLPKGRSNSKKKRQKKQNTSCSKNRGRTTAHTKCWYEGNNRFGLLMVENLEEHSEASNIE

SEQ ID NO: 6772 - protein, 520 aa, Homo sapiens
  Payload ID: 1455;
  Gene Symbol: ASTE1;
  Gene Name: asteroid homolog 1 (Drosophila);
  Uniprot ID:  Q2TB18;
  ENSP ID: ENSP00000421019
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQVKLQDFFQCGTYVCPDALNLGLPEWVLVALAKGQLSPFISDALVLRRTILPTQVENMQQPNAHRISQPIRQIIYGLLLNASPHLDKTSWNALPPQPLAFSEVERINKNIRTSIIDAVELAKDHSDLSRLTELSLRRRQMLLLETLKVKQTILEPIPTSLKLPIAVSCYWLQHTETKAKLHHLQSLLLTMLVGPLIAIINSPGNVDPVPRQAQCLAPR

SEQ ID NO: 6773 - protein, 48 aa, Homo sapiens
  Payload ID: 1455;
  Gene Symbol: ASTE1;
  Gene Name: asteroid homolog 1 (Drosophila);
  ENSP ID: ENSP00000422851
MGIRGLMSFVEDHSNEFFTDLKLRDTKIVIDGYALFHRLCFSSNLDLR

SEQ ID NO: 6774 - protein, 97 aa, Homo sapiens
  Payload ID: 1455;
  Gene Symbol: ASTE1;
  Gene Name: asteroid homolog 1 (Drosophila);
  ENSP ID: ENSP00000423347
  MOD_RES (1)..(1): Any amino acid
XNVKELLCCSMEEYQQSQMLLLETLKVKQTILEPIPTSLKLPIAVSCYWLQHTETKAKLHHLQSLLLTMLVGPLIAIINSPGKEELQEDGAKMLYAE

SEQ ID NO: 6775 - protein, 49 aa, Homo sapiens
  Payload ID: 1455;
  Gene Symbol: ASTE1;
  Gene Name: asteroid homolog 1 (Drosophila);
  ENSP ID: ENSP00000425683
MGIRGLMSFVEDHSNEFFTDLKLRDTKIVIDGYALFHRLCFSSNLDLRY

SEQ ID NO: 6776 - protein, 72 aa, Homo sapiens
  Payload ID: 1455;
  Gene Symbol: ASTE1;
  Gene Name: asteroid homolog 1 (Drosophila);
  ENSP ID: ENSP00000426363
MGIRGLMSFVEDHSNEFFTDLKLRDTKIVIDGYALFHRLCFSSNLDLRWKTCSNQMPTEYLSPSGKSSMGFF

SEQ ID NO: 6777 - protein, 704 aa, Homo sapiens
  Payload ID: 1455;
  Gene Symbol: ASTE1;
  Gene Name: asteroid homolog 1 (Drosophila);
  ENSP ID: ENSP00000426421
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQVKLQDFFQCGTYVCPDALNLGLPEWVLVALAKGQLSPFISDALVLRRTILPTQVENMQQPNAHRISQPIRQIIYGLLLNASPHLDKTSWNALPPQPLAFSEVERINKNIRTSIIDAVELAKDHSDLSRLTELSLRRRQMLLLETLKVKQTILEPIPTSLKLPIAVSCYWLQHTETKAKLHHLQSLLLTMLVGPLIAIINSPGKEELQEDGAKMLYAEFQRVKAQTRLGTRLDLDTAHIFCQWQSCLQMGMYLNQLLSTPLPEPDLTRPSAFNTLNEDIWTHTKYGGTLHVSRLYSGSLVHGLCQQLLASTSVESLLSICPEAKQLYEYLFNATRSYAPAEIFLPKGRSNSKKKRQKKQNTSCSKNRGRTTAHTKCWYEGNNRFGLLMVENLEEHSEASNIE

SEQ ID NO: 6778 - protein, 7 aa, Homo sapiens
  Payload ID: 1455;
  Gene Symbol: ASTE1;
  Gene Name: asteroid homolog 1 (Drosophila);
  ENSP ID: ENSP00000427303
MGIRGLM

SEQ ID NO: 6779 - protein, 1294 aa, Homo sapiens
  Payload ID: 1456;
  Gene Symbol: ASTN1;
  Gene Name: astrotactin 1;
  Uniprot ID:  O14525;
  ENSP ID: ENSP00000354536
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRKAGLILSQLGDLSSWCNGLLQEPKISLRRSSLKYLGCRYSEIKPYGLDWAELSRDLRKTCEEQTLSIPYNDYGDSKEI

SEQ ID NO: 6780 - protein, 1228 aa, Homo sapiens
  Payload ID: 1456;
  Gene Symbol: ASTN1;
  Gene Name: astrotactin 1;
  ENSP ID: ENSP00000356629
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRLPACWDSQRSCR

SEQ ID NO: 6781 - protein, 1216 aa, Homo sapiens
  Payload ID: 1456;
  Gene Symbol: ASTN1;
  Gene Name: astrotactin 1;
  Uniprot ID:  O14525;
  ENSP ID: ENSP00000395041
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPR

SEQ ID NO: 6782 - protein, 440 aa, Homo sapiens
  Payload ID: 1457;
  Gene Symbol: ASTN2;
  Gene Name: astrotactin 2;
  Uniprot ID:  O75129;
  ENSP ID: ENSP00000288520
MNTLLCKGMFCLLSWEADSRGRLGEYTLQPLSLQTEETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 6783 - protein, 1339 aa, Homo sapiens
  Payload ID: 1457;
  Gene Symbol: ASTN2;
  Gene Name: astrotactin 2;
  Uniprot ID:  O75129;
  ENSP ID: ENSP00000314038
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKAAAEATQETVESLMQKFKESFRANTPIEIGQLQPPLRSTSAGKRKRRSKSRGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 6784 - protein, 395 aa, Homo sapiens
  Payload ID: 1457;
  Gene Symbol: ASTN2;
  Gene Name: astrotactin 2;
  Uniprot ID:  O75129;
  ENSP ID: ENSP00000339925
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYYLTLSKVSPF

SEQ ID NO: 6785 - protein, 194 aa, Homo sapiens
  Payload ID: 1457;
  Gene Symbol: ASTN2;
  Gene Name: astrotactin 2;
  ENSP ID: ENSP00000351460
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTVYCWITFIDLRILNQPCIPGMKPT

SEQ ID NO: 6786 - protein, 1288 aa, Homo sapiens
  Payload ID: 1457;
  Gene Symbol: ASTN2;
  Gene Name: astrotactin 2;
  Uniprot ID:  O75129;
  ENSP ID: ENSP00000354504
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 6787 - protein, 402 aa, Homo sapiens
  Payload ID: 1457;
  Gene Symbol: ASTN2;
  Gene Name: astrotactin 2;
  ENSP ID: ENSP00000355116
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGRYYLTLSKVSPF

SEQ ID NO: 6788 - protein, 1062 aa, Homo sapiens
  Payload ID: 1457;
  Gene Symbol: ASTN2;
  Gene Name: astrotactin 2;
  ENSP ID: ENSP00000363098
QTHNSVIGVPIRETPILDDYDCEEDEEPPRRANHVSREDEFGSQVTHTLDSLGHPGEEKVDFEKKAAAEATQETVESLMQKFKESFRANTPIEIGQLQPPLRSTSAGKRKRRSKSRGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 6789 - protein, 98 aa, Homo sapiens
  Payload ID: 1457;
  Gene Symbol: ASTN2;
  Gene Name: astrotactin 2;
  ENSP ID: ENSP00000412099
  MOD_RES (1)..(1): Any amino acid
XMAYNTLMEVSASMLFRVQHHYNSHYEKFGDFVWRSEDELGPSLLESFMSLQDINLLERRPGRPQRPGNPLSNVSWRISEIAPTSHTDMSAGIKETAS

SEQ ID NO: 6790 - protein, 706 aa, Homo sapiens
  Payload ID: 1458;
  Gene Symbol: ASUN;
  Gene Name: asunder spermatogenesis regulator;
  Uniprot ID:  Q9NVM9;
  ENSP ID: ENSP00000261191
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKELSPVLTSEVHSVRAGRHLATKLNILVQQHFDLASTTITNIPMKEEQHANTSANYDVELLHHKDAHVDFLKSGDSHLGGGSREGSFKETITLKWCTPRTNNIELHYCTGAYRISPVDVNSRPSSCLTNFLLNGRSVLLEQPRKSGSKVISHMLSSHGGEIFLHVLSSSRSILEDPPSISEGCGGRVTDYRITDFGEFMRENRLTPFLDPRYKIDGSLEVPLERAKDQLEKHTRYWPMIISQTTIFNMQAVVPLASVIVKESLTEEDVLNCQKTIYNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 6791 - protein, 163 aa, Homo sapiens
  Payload ID: 1458;
  Gene Symbol: ASUN;
  Gene Name: asunder spermatogenesis regulator;
  ENSP ID: ENSP00000443066
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICI

SEQ ID NO: 6792 - protein, 353 aa, Homo sapiens
  Payload ID: 1458;
  Gene Symbol: ASUN;
  Gene Name: asunder spermatogenesis regulator;
  ENSP ID: ENSP00000445645
GDSHLGGGSREGSFKETITLKWCTPRTNNIELHYCTGAYRISPVDVNSRPSSCLTNFLLNGRSVLLEQPRKSGSKVISHMLSSHGGEIFLHVLSSSRSILEDPPSISEGCGGRVTDYRITVVPLASVIVKESLTEEDVLNCQKTIYNLVDMERKNDPLPISTVGTRGKGPKRDEQYRIMWNELETLVRAHINNSEKHQRVLECLMACRSKPPEEEERKKRGRKREDKEDKSEKAVKDYEQEKSWQDSERLKGILERGKEELAEAEIIKDSPDSPEPPNKKPLVEMDETPQVEKSKGPVSLLSLWSNRINTANSRKHQEFAGRLNSVNNRAELYQHLKEENGMETTENGKASRQ

SEQ ID NO: 6793 - protein, 225 aa, Homo sapiens
  Payload ID: 1458;
  Gene Symbol: ASUN;
  Gene Name: asunder spermatogenesis regulator;
  ENSP ID: ENSP00000446183
MKIFSESHKTVFVVDHCPYMAESCRQHVEFDMLVKNRTQGIIPLAPISKSLWTCSVESSMEYCRIMYDIFPFKKLVNFIVSDSGAHVLNSWTQEDQNLQELMAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKE

SEQ ID NO: 6794 - protein, 124 aa, Homo sapiens
  Payload ID: 1458;
  Gene Symbol: ASUN;
  Gene Name: asunder spermatogenesis regulator;
  ENSP ID: ENSP00000448467
MAALAAVGPPNPRADPECCSILHGLVAAVETLCKITEYQHEARTLLMENAERVGNRGRIICITNAKSDSHVRMLEDCVQETIHEHNKLAANSDHLMQIQKCELVLIHTYPVGEDSLVSDRSKKE

SEQ ID NO: 6795 - protein, 153 aa, Homo sapiens
  Payload ID: 1458;
  Gene Symbol: ASUN;
  Gene Name: asunder spermatogenesis regulator;
  ENSP ID: ENSP00000448985
  MOD_RES (1)..(1): Any amino acid
XATKLNILVQQHFDLASTTITNIPMKEEQHANTSANYDVELLHHKDAHVDFLKSELHYCTGAYRISPVDVNSRPSSCLTNFLLNDPRYKIDGSLEVPLERAKDQLEKHTRYWPMIISQTTIFNMQAVVPLASVIVKESLTEEDVLNCQKTIYN

SEQ ID NO: 6796 - protein, 2301 aa, Homo sapiens
  Payload ID: 1459;
  Gene Symbol: AHCTF1;
  Gene Name: AT hook containing transcription factor 1;
  Uniprot ID:  Q8WYP5;
  ENSP ID: ENSP00000355464
MDSLAGLSPREAAGVLSLSCVGVCSTCAWAWPHGSMRDLRAQVTSGLLPFPEVTLQALGEDEITLESVLRGKFAAGKNGLACLACGPQLEVVNSITGERLSAYRFSGVNEQPPVVLAVKEFSWQKRTGLLIGLEETEGSVLCLYDLGISKVVKAVVLPGRVTAIEPIINHGGASASTQHLHPSLRWLFGVAAVVTDVGQILLVDLCLDDLSCNQNEVEASDLEVLTGIPAEVPHIRESVMRQGRHLCFQLVSPTGTAVSTLSYISRTNQLAVGFSDGYLALWNMKSMKREYYIQLESGQVPVYAVTFQEPENDPRNCCYLWAVQSTQDSEGDVLSLHLLQLAFGNRKCLASGQILYEGLEYCEERYTLDLTGGMFPLRGQTSNTKLLGCQSIEKFRSHGDREEGVNEALSPDTSVSVFTWQVNIYGQGKPSVYLGLFDINRWYHAQMPDSLRSGEYLHNCSYFALWSLESVVSRTSPHGILDILVHERSLNRGVPPSYPPPEQFFNPSTYNFDATCLLNSGVVHLTCTGFQKETLTFLKKSGPSLNELIPDGYNRCLVAGLLSPRFVDVQPSSLSQEEQLEAILSAAIQTSSLGLLTGYIRRWITEEQPNSATNLRFVLEWTWNKVVLTKEEFDRLCVPLFDGSCHFMDPQTIQSIQQCYLLLSNLNIVLSCFASEAREITERGLIDLSNKFVVSHLICQYAQVVLWFSHSGLLPEGIDDSVQLSRLCYNYPVIQNYYTSRRQKFERLSRGKWNPDCLMIDGLVSQLGERIEKLWKRDEGGTGKYPPASLHAVLDMYLLDGVTEAAKHSITIYLLLDIMYSFPNKTDTPIESFPTVFAISWGQVKLIQGFWLIDHNDYESGLDLLFHPATAKPLSWQHSKIIQAFMSQGEHRQALRYIQTMKPTVSSGNDVILHLTVLLFNRCMVEAWNFLRQHCNRLNIEELLKHMYEVCQEMGLMEDLLKLPFTDTEQECLVKFLQSSASVQNHEFLLVHHLQRANYVPALKLNQTLKINVMNDRDPRLRERSLARNSILDQYGKILPRVHRKLAIERAKPYHLSTSSVFRLVSRPKPLSAVPKQVVTGTVLTRSVFINNVLSKIGEVWASKEPINSTTPFNSSKIEEPSPIVYSLPAPELPEAFFGTPISKASQKISRLLDLVVQPVPRPSQCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 6797 - protein, 2275 aa, Homo sapiens
  Payload ID: 1459;
  Gene Symbol: AHCTF1;
  Gene Name: AT hook containing transcription factor 1;
  Uniprot ID:  Q8WYP5;
  ENSP ID: ENSP00000355465
MAAERRCGSMRDLRAQVTSGLLPFPEVTLQALGEDEITLESVLRGKFAAGKNGLACLACGPQLEVVNSITGERLSAYRFSGVNEQPPVVLAVKEFSWQKRTGLLIGLEETEGSVLCLYDLGISKVVKAVVLPGRVTAIEPIINHGGASASTQHLHPSLRWLFGVAAVVTDVGQILLVDLCLDDLSCNQNEVEASDLEVLTGIPAEVPHIRESVMRQGRHLCFQLVSPTGTAVSTLSYISRTNQLAVGFSDGYLALWNMKSMKREYYIQLESGQVPVYAVTFQEPENDPRNCCYLWAVQSTQDSEGDVLSLHLLQLAFGNRKCLASGQILYEGLEYCEERYTLDLTGGMFPLRGQTSNTKLLGCQSIEKFRSHGDREEGVNEALSPDTSVSVFTWQVNIYGQGKPSVYLGLFDINRWYHAQMPDSLRSGEYLHNCSYFALWSLESVVSRTSPHGILDILVHERSLNRGVPPSYPPPEQFFNPSTYNFDATCLLNSGVVHLTCTGFQKETLTFLKKSGPSLNELIPDGYNRCLVAGLLSPRFVDVQPSSLSQEEQLEAILSAAIQTSSLGLLTGYIRRWITEEQPNSATNLRFVLEWTWNKVVLTKEEFDRLCVPLFDGSCHFMDPQTIQSIQQCYLLLSNLNIVLSCFASEAREITERGLIDLSNKFVVSHLICQYAQVVLWFSHSGLLPEGIDDSVQLSRLCYNYPVIQNYYTSRRQKFERLSRGKWNPDCLMIDGLVSQLGERIEKLWKRDEGGTGKYPPASLHAVLDMYLLDGVTEAAKHSITIYLLLDIMYSFPNKTDTPIESFPTVFAISWGQVKLIQGFWLIDHNDYESGLDLLFHPATAKPLSWQHSKIIQAFMSQGEHRQALRYIQTMKPTVSSGNDVILHLTVLLFNRCMVEAWNFLRQHCNRLNIEELLKHMYEVCQEMGLMEDLLKLPFTDTEQECLVKFLQSSASVQNHEFLLVHHLQRANYVPALKLNQTLKINVMNDRDPRLRERSLARNSILDQYGKILPRVHRKLAIERAKPYHLSTSSVFRLVSRPKPLSAVPKQVVTGTVLTRSVFINNVLSKIGEVWASKEPINSTTPFNSSKIEEPSPIVYSLPAPELPEAFFGTPISKASQKISRLLDLVVQPVPRPSQCSEFIQQSSMKSPLYLVSRSLPSSSQLKGSPQAISRASELHLLETPLVVKKAKSLAMSVTTSGFSEFTPQSILRSTLRSTPLASPSPSPGRSPQRLKETRISFVEEDVHPKWIPGAADDSKLEVFTTPKKCAVPVETEWLKSKDRTTSFFLNSPEKEHQEMDEGSQSLEKLDVSKGNSSVSITSDETTLEYQDAPSPEDLEETVFTASKPKSSSTALTTNVTEQTEKDGDKDVFASEVTPSDLQKQMGNLEDAETKDLLVAAEAFSELNHLSPVQGTEASLCAPSVYEGKIFTQKSKVPVLDEGLTSVETYTPAIRANDNKSMADVLGDGGNSSLTISEGPIVSERRLNQEVALNLKEDHEVEVGVLKESVDLPEEKLPISDSPPDTQEIHVIEQEKLEAQDSGEEARNLSFNELYPSGTLKLQYNFDTIDQQFCDLADNKDTAECDIAEVDGELFVAQSNFTLILEGEEGEVEPGDFASSDVLPKAANTATEEKLVCSGENDNHGQIANLPSAVTSDQKSQKVDTLPYVPEPIKVAIAENLLDVIKDTRSKEITSDTMEQSIHETIPLVSQNIMCPTKLVKSAFKTAQETSTMTMNVSQVDDVVSSKTRTRGQRIQNVNVKSAQQEASADVATPKMPGQSVRKKTRKAKEISEASENIYSDVRGLSQNQQIPQNSVTPRRGRRKKEVNQDILENTSSVEQELQITTGRESKRLKSSQLLEPAVEETTKKEVKVSSVTKRTPRRIKRSVENQESVEIINDLKVSTVTSPSRMIRKLRSTNLDASENTGNKQDDKSSDKQLRIKHVRRVRGREVSPSDVREDSNLESSQLTVQAEFDMSAIPRKRGRPRKINPSEDVGSKAVKEERSPKKKEAPSIRRRSTRNTPAKSENVDVGKPALGKSILVPNEELSMVMSSKKKLTKKTESQSQKRSLHSVSEERTDEMTHKETNEQEERLLATASFTKSSRSSRTRSSKAILLPDLSEPNNEPLFSPASEVPRKAKAKKIEVPAQLKELVSDLSSQFVISPPALRSRQKNTSNKNKLEDELKDDAQSVETLGKPKAKRIRTSKTKQASKNTEKESAWSPPPIEIRLISPLASPADGVKSKPRKTTEVTGTGLGRNRKKLSSYPKQILRRKML

SEQ ID NO: 6798 - protein, 67 aa, Homo sapiens
  Payload ID: 1459;
  Gene Symbol: AHCTF1;
  Gene Name: AT hook containing transcription factor 1;
  ENSP ID: ENSP00000417115
MRDLRAQVTSGLLPFPEVTLQALGEDEITLESVLRGKFAAGKNGLACLACGPQLEVVNSITGERLSA

SEQ ID NO: 6799 - protein, 80 aa, Homo sapiens
  Payload ID: 1459;
  Gene Symbol: AHCTF1;
  Gene Name: AT hook containing transcription factor 1;
  ENSP ID: ENSP00000418007
ESQSQKRSLHSVSEERTDEMTHKETNEQEERLLATASFTKSSRSSRTRSSKAILLPDLSEPNNEPLFSPASEVPRKAKER

SEQ ID NO: 6800 - protein, 1603 aa, Homo sapiens
  Payload ID: 1460;
  Gene Symbol: AHDC1;
  Gene Name: AT hook, DNA binding motif, containing 1;
  Uniprot ID:  Q5TGY3;
  ENSP ID: ENSP00000247087
MRVKPQGLVVTSSAVCSSPDYLREPKYYPGGPPTPRPLLPTRPPASPPDKAFSTHAFSENPRPPPRRDPSTRRPPVLAKGDDPLPPRAARPVSQARCPTPVGDGSSSRRCWDNGRVNLRPVVQLIDIMKDLTRLSQDLQHSGVHLDCGGLRLSRPPAPPPGDLQYSFFSSPSLANSIRSPEERATPHAKSERPSHPLYEPEPEPRDSPQPGQGHSPGATAAATGLPPEPEPDSTDYSELADADILSELASLTCPEAQLLEAQALEPPSPEPEPQLLDPQPRFLDPQALEPLGEALELPPLQPLADPLGLPGLALQALDTLPDSLESQLLDPQALDPLPKLLDVPGRRLEPQQPLGHCPLAEPLRLDLCSPHGPPGPEGHPKYALRRTDRPKILCRRRKAGRGRKADAGPEGRLLPLPMPTGLVAALAEPPPPPPPPPPALPGPGPVSVPELKPESSQTPVVSTRKGKCRGVRRMVVKMAKIPVSLGRRNKTTYKVSSLSSSLSVEGKELGLRVSAEPTPLLKMKNNGRNVVVVFPPGEMPIILKRKRGRPPKNLLLGPGKPKEPAVVAAEAATVAAATMAMPEVKKRRRRKQKLASPQPSYAADANDSKAEYSDVLAKLAFLNRQSQCAGRCSPPRCWTPSEPESVHQAPDTQSISHFLHRVQGFRRRGGKAGGFGGRGGGHAAKSARCSFSDFFEGIGKKKKVVAVAAAGVGGPGLTELGHPRKRGRGEVDAVTGKPKRKRRSRKNGTLFPEQVPSGPGFGEAGAEWAGDKGGGWAPHHGHPGGQAGRNCGFQGTEARAFASTGLESGASGRGSYYSTGAPSGQTELSQERQNLFTGYFRSLLDSDDSSDLLDFALSASRPESRKASGTYAGPPTSALPAQRGLATFPSRGAKASPVAVGSSGAGADPSFQPVLSARQTFPPGRAASYGLTPAASDCRAAETFPKLVPPPSAMARSPTTHPPANTYLPQYGGYGAGQSVFAPTKPFTGQDCANSKDCSFAYGSGNSLPASPSSAHSAGYAPPPTGGPCLPPSKASFFSSSEGAPFSGSAPTPLRCDSRASTVSPGGYMVPKGTTASATSAASAASSSSSSFQPSPENCRQFAGASQWPFRQGYGGLDWASEAFSQLYNPSFDCHVSEPNVILDISNYTPQKVKQQTAVSETFSESSSDSTQFNQPVGGGGFRRANSEASSSEGQSSLSSLEKLMMDWNEASSAPGYNWNQSVLFQSSSKPGRGRRKKVDLFEASHLGFPTSASAAASGYPSKRSTGPRQPRGGRGGGACSAKKERGGAAAKAKFIPKPQPVNPLFQDSPDLGLDYYSGDSSMSPLPSQSRAFGVGERDPCDFIGPYSMNPSTPSDGTFGQGFHCDSPSLGAPELDGKHFPPLAHPPTVFDAGLQKAYSPTCSPTLGFKEELRPPPTKLAACEPLKHGLQGASLGHAAAAQAHLSCRDLPLGQPHYDSPSCKGTAYWYPPGSAARSPPYEGKVGTGLLADFLGRTEAACLSAPHLASPPATPKADKEPLEMARPPGPPRGPAAAAAGYGCPLLSDLTLSPVPRDSLLPLQDTAYRYPGFMPQAHPGLGGGPKSGFLGPMAEPHPEDTFTVTSL

SEQ ID NO: 6801 - protein, 1603 aa, Homo sapiens; identical to SEQ ID NO: 6800
  Payload ID: 1460;
  Gene Symbol: AHDC1;
  Gene Name: AT hook, DNA binding motif, containing 1;
  Uniprot ID:  Q5TGY3;
  ENSP ID: ENSP00000363123

SEQ ID NO: 6802 - protein, 2285 aa, Homo sapiens
  Payload ID: 1461;
  Gene Symbol: ARID1A;
  Gene Name: AT rich interactive domain 1A (SWI-like);
  Uniprot ID:  O14497;
  ENSP ID: ENSP00000320485
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 6803 - protein, 1902 aa, Homo sapiens
  Payload ID: 1461;
  Gene Symbol: ARID1A;
  Gene Name: AT rich interactive domain 1A (SWI-like);
  Uniprot ID:  O14497;
  ENSP ID: ENSP00000363267
MDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 6804 - protein, 2068 aa, Homo sapiens
  Payload ID: 1461;
  Gene Symbol: ARID1A;
  Gene Name: AT rich interactive domain 1A (SWI-like);
  Uniprot ID:  O14497;
  ENSP ID: ENSP00000387636
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 6805 - protein, 1182 aa, Homo sapiens
  Payload ID: 1461;
  Gene Symbol: ARID1A;
  Gene Name: AT rich interactive domain 1A (SWI-like);
  ENSP ID: ENSP00000390317
  MOD_RES (1)..(1): Any amino acid
XECKIERGEDPPPDIFAAADSKKSQPKIQPPSPAGSGSMQGPQTPQSTSSSMAEGGDLKPPTPASTPHSQIPPLPGMRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 6806 - protein, 144 aa, Homo sapiens
  Payload ID: 1461;
  Gene Symbol: ARID1A;
  Gene Name: AT rich interactive domain 1A (SWI-like);
  ENSP ID: ENSP00000432368
  MOD_RES (1)..(1): Any amino acid
XPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQEPRRHGG

SEQ ID NO: 6807 - protein, 122 aa, Homo sapiens
  Payload ID: 1461;
  Gene Symbol: ARID1A;
  Gene Name: AT rich interactive domain 1A (SWI-like);
  ENSP ID: ENSP00000432473
MDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQ

SEQ ID NO: 6808 - protein, 188 aa, Homo sapiens
  Payload ID: 1461;
  Gene Symbol: ARID1A;
  Gene Name: AT rich interactive domain 1A (SWI-like);
  ENSP ID: ENSP00000436692
  MOD_RES (1)..(1): Any amino acid
XGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQISSMPVLCFLCLWARAQDFDSNNNLFT

SEQ ID NO: 6809 - protein, 1141 aa, Homo sapiens [sequence omitted]

SEQ ID NO: 6810 - protein, 2236 aa, Homo sapiens
  Payload ID: 1462;
  Gene Symbol: ARID1B;
  Gene Name: AT rich interactive domain 1B (SWI 1-like);
  Uniprot ID:  Q8NFD5;
  ENSP ID: ENSP00000055163
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 6811 - protein, 728 aa, Homo sapiens
  Payload ID: 1462;
  Gene Symbol: ARID1B;
  Gene Name: AT rich interactive domain 1B (SWI 1-like);
  ENSP ID: ENSP00000313006
QMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPVVQMEPRACDTGGSGRKASWSRPAPRARAGGSRHTQASGGRRQRHPGLQKPLDSLPPTQQVASPIPVPSLGKVSGNIFVVKGK

SEQ ID NO: 6812 - protein, 2249 aa, Homo sapiens
  Payload ID: 1462;
  Gene Symbol: ARID1B;
  Gene Name: AT rich interactive domain 1B (SWI 1-like);
  Uniprot ID:  Q8NFD5;
  ENSP ID: ENSP00000344546
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQDSGDATWKETFWLMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 6813 - protein, 273 aa, Homo sapiens
  Payload ID: 1462;
  Gene Symbol: ARID1B;
  Gene Name: AT rich interactive domain 1B (SWI 1-like);
  ENSP ID: ENSP00000383596
AAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPGKWRRCSHWPRKAQAPGLGGSGKVVSQSGQQGTWDF

SEQ ID NO: 6814 - protein, 1758 aa, Homo sapiens
  Payload ID: 1462;
  Gene Symbol: ARID1B;
  Gene Name: AT rich interactive domain 1B (SWI 1-like);
  ENSP ID: ENSP00000412835
SPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 6815 - protein, 306 aa, Homo sapiens
  Payload ID: 1462;
  Gene Symbol: ARID1B;
  Gene Name: AT rich interactive domain 1B (SWI 1-like);
  ENSP ID: ENSP00000488727
  MOD_RES (1)..(1): Any amino acid
XRPFPGNMSSMTPSSPGMSQQGGPGMGPPMPTVNRKAQEAAAAVMQAAANSAQSRPPYIRSPAYPSQSGAGGRPMFSSQHPNYGNSQAPMVHQPDQYGQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQ

SEQ ID NO: 6816 - protein, 1835 aa, Homo sapiens
  Payload ID: 1463;
  Gene Symbol: ARID2;
  Gene Name: AT rich interactive domain 2 (ARID, RFX-like);
  Uniprot ID:  Q68CP9;
  ENSP ID: ENSP00000335044
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 6817 - protein, 401 aa, Homo sapiens
  Payload ID: 1463;
  Gene Symbol: ARID2;
  Gene Name: AT rich interactive domain 2 (ARID, RFX-like);
  ENSP ID: ENSP00000388357
MEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRNMNED

SEQ ID NO: 6818 - protein, 1445 aa, Homo sapiens
  Payload ID: 1463;
  Gene Symbol: ARID2;
  Gene Name: AT rich interactive domain 2 (ARID, RFX-like);
  ENSP ID: ENSP00000397307
MRGMEILGNLCKAEDNGVLICEYVDQDSYREIICHLTLPDVLLVISTLEVLYMLTEMGDVACTKIAKVEKSIAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 6819 - protein, 1639 aa, Homo sapiens
  Payload ID: 1463;
  Gene Symbol: ARID2;
  Gene Name: AT rich interactive domain 2 (ARID, RFX-like);
  ENSP ID: ENSP00000415650
MDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRR

SEQ ID NO: 6820 - protein, 64 aa, Homo sapiens
  Payload ID: 1463;
  Gene Symbol: ARID2;
  Gene Name: AT rich interactive domain 2 (ARID, RFX-like);
  ENSP ID: ENSP00000481488
  MOD_RES (1)..(1): Any amino acid
XGLKQDEPGQAGSQKSSTKQPTVGGTSSTPRAQKAIVNHPSAALMALRRGSRNLVFRDFTVSMP

SEQ ID NO: 6821 - protein, 593 aa, Homo sapiens
  Payload ID: 1464;
  Gene Symbol: ARID3A;
  Gene Name: AT rich interactive domain 3A (BRIGHT-like);
  Uniprot ID:  Q99856;
  ENSP ID: ENSP00000263620
MKLQAVMETLLQRQQRARQELEARQQLPPDPPAAPPGRARAAPDEDREPESARMQRAQMAALAAMRAAAAGLGHPASPGGSEDGPPGSEEEDAAREGTPGSPGRGREGPGEEHFEDMASDEDMKPKWEEEEMEEDLGEDEEEEEEDYEDEEEEEDEEGLGPPGPASLGTTALFPRKAQPPQAFRGDGVPRVLGGQERPGPGPAHPGGAAHVAPQLQPPDHGDWTYEEQFKQLYELDGDPKRKEFLDDLFSFMQKRGTPVNRIPIMAKQVLDLFMLYVLVTEKGGLVEVINKKLWREITKGLNLPTSITSAAFTLRTQYMKYLYPYECEKRGLSNPNELQAAIDSNRREGRRQSFGGSLFAYSPGGAHGMLSSPKLPVSSLGLAASTNGSSITPAPKIKKEEDSAIPITVPGRLPVSLAGHPVVAAQAAAVQAAAAQAAVAAQAAALEQLREKLESAEPPEKKMALVADEQQRLMQRALQQNFLAMAAQLPMSIRINSQASESRQDSAVNLTGTNGSNSISMSVEINGIMYTGVLFAQPPAPTPTSAPNKGGGGGGGSSSNAGGRGGNTGTSGGQAGPAGLSTPSTSTSNNSLP

SEQ ID NO: 6822 - protein, 96 aa, Homo sapiens
  Payload ID: 1464;
  Gene Symbol: ARID3A;
  Gene Name: AT rich interactive domain 3A (BRIGHT-like);
  ENSP ID: ENSP00000440911
  MOD_RES (1)..(1): Any amino acid
XFPRKAQPPQAFRGDGVPRVLGGQERPGPGPAHPGGAAHVAPQLQPPDHGDWTYEEQFKQLYELDGDPKRKEFLDDLFSFMQKRVQKLTRRGGRRL

SEQ ID NO: 6823 - protein, 338 aa, Homo sapiens
  Payload ID: 1464;
  Gene Symbol: ARID3A;
  Gene Name: AT rich interactive domain 3A (BRIGHT-like);
  ENSP ID: ENSP00000464969
EDEEGLGPPGPASLGTTALFPRKAQPPQAFRGDGVPRVLGGQERPGPGPAHPGGAAHVAPQLQPPDHGDWTYEEQFKQLYELDGDPKRKEFLDDLFSFMQKRGTPVNRIPIMAKQVLDLFMLYVLVTEKGGLVEVINKKLWREITKGLNLPTSITSAAFTLRTQYMKYLYPYECEKRGLSNPNELQAAIDSNRREGRRQSFGGSLFAYSPGGAHGMLSSPKLPVSSLGLAASTNGSSITPAPKIKKASESRQDSAVNLTGTNGSNSISMSVEINGIMYTGVLFAQPPAPTPTSAPNKGGGGGGGSSSNAGGRGGNTGTSGGQAGPAGLSTPSTSTSNN

SEQ ID NO: 6824 - protein, 560 aa, Homo sapiens
  Payload ID: 1465;
  Gene Symbol: ARID3B;
  Gene Name: AT rich interactive domain 3B (BRIGHT-like);
  Uniprot ID:  Q8IVW6;
  ENSP ID: ENSP00000343126
MEPLQQQQQQQQQQQKQPHLAPLQMDAREKQGQQMREAQFLYAQKLVTQPTLLSATAGRPSGSTPLGPLARVPPTAAVAQVFERGNMNSEPEEEDGGLEDEDGDDEVAEVAEKETQAASKYFHVQKVARQDPRVAPMSNLLPAPGLPPHGQQAKEDHTKDASKASPSVSTAGQPNWNLDEQLKQNGGLAWSDDADGGRGREISRDFAKLYELDGDPERKEFLDDLFVFMQKRGTPINRIPIMAKQILDLYMLYKLVTEKGGLVEIINKKIWREITKGLNLPTSITSAAFTLRTQYMKYLYAYECEKKALSSPAELQAAIDGNRREGRRPSYSSSLFGYSPAAATAAAAAGAPALLSPPKIRFPILGLGSSSGTNTSSPRISPATTLRKGDGAPVTTVPVPNRLAVPVTLASQQAGTRTAALEQLRERLESGEPAEKKASRLSEEEQRLVQQAFQRNFFSMARQLPMKIRINGREDRAEASAAALNLTTSSIGSINMSVDIDGTTYAGVLFAQKPVVHLITGSAPQSLGSSASSSSSSHCSPSPTSSRGTPSAEPSTSWSL

SEQ ID NO: 6825 - protein, 138 aa, Homo sapiens
  Payload ID: 1465;
  Gene Symbol: ARID3B;
  Gene Name: AT rich interactive domain 3B (BRIGHT-like);
  ENSP ID: ENSP00000455668
MAKQILDLYMLYKLVTEKGGLVEIINKKIWREITKGLNLPTSITSAAFTLRTQYMKYLYAYECEKKALSSPAELQAAIDGNRREGRRPSYSSSLFGYSPAAATAAAAAGAPALLSPPKIRFPILGLGSSSGTNTSSPR

SEQ ID NO: 6826 - protein, 561 aa, Homo sapiens
  Payload ID: 1465;
  Gene Symbol: ARID3B;
  Gene Name: AT rich interactive domain 3B (BRIGHT-like);
  Uniprot ID:  Q8IVW6;
  ENSP ID: ENSP00000477878
MEPLQQQQQQQQQQQKQPHLAPLQMDAREKQGQQMREAQFLYAQKLVTQPTLLSATAGRPSGSTPLGPLARVPPTAAVAQVFERGNMNSEPEEEDGGLEDEDGDDEVAEVAEKETQAASKYFHVQKVARQDPRVAPMSNLLPAPGLPPHGQQAKEDHTKDASKASPSVSTAGQPNWNLDEQLKQNGGLAWSDDADGGRGREISRDFAKLYELDGDPERKEFLDDLFVFMQKRGTPINRIPIMAKQILDLYMLYKLVTEKGGLVEIINKKIWREITKGLNLPTSITSAAFTLRTQYMKYLYAYECEKKALSSPAELQAAIDGNRREGRRPSYSSSLFGYSPAAATAAAAAGAPALLSPPKIRFPILGLGSSSGTNTSSPRISPATTLRKGDGAPVTTVPVPNRLAVPVTLASQQAGTRTAALEQLRERLESGEPAEKKASRLSEEEQRLVQQAFQRNFFSMARQLPMKIRINGRAEDRAEASAAALNLTTSSIGSINMSVDIDGTTYAGVLFAQKPVVHLITGSAPQSLGSSASSSSSSHCSPSPTSSRGTPSAEPSTSWSL

SEQ ID NO: 6827 - protein, 412 aa, Homo sapiens
  Payload ID: 1466;
  Gene Symbol: ARID3C;
  Gene Name: AT rich interactive domain 3C (BRIGHT-like);
  Uniprot ID:  A6NKF2;
  ENSP ID: ENSP00000368189
MEALQKQQAARLAQGVGPLAPACPLLPPQPPLPDHRTLQAPEGALGNVGAEEEEDAEEDEEKREEAGAEEEAAEESRPGAQGPSSPSSQPPGLHPHEWTYEEQFKQLYELDADPKRKEFLDDLFSFMQKRGTPVNRVPIMAKQVLDLYALFRLVTAKGGLVEVINRKVWREVTRGLSLPTTITSAAFTLRTQYMKYLYPYECETRALSSPGELQAAIDSNRREGRRQAYTATPLFGLAGPPPRGAQDPALGPGPAPPATQSSPGPAQGSTSGLPAHACAQLSPSPIKKEESGIPNPCLALPVGLALGPTREKLAPEEPPEKRAVLMGPMDPPRPCMPPSFLPRGKVPLREERLDGPLNLAGSGISSINMALEINGVVYTGVLFARRQPVPASQGPTNPAPPPSTGPPSSILP

SEQ ID NO: 6828 - protein, 1188 aa, Homo sapiens
  Payload ID: 1467;
  Gene Symbol: ARID4A;
  Gene Name: AT rich interactive domain 4A (RBP 1-like);
  Uniprot ID:  P29374;
  ENSP ID: ENSP00000344556
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTDELDNMNSTERISFLQEKLQEIRKYYMSLKSEVATIDRRRKRLKKKDREVSHAGASMSSASSDTGMSPSSSSPPQNVLAVECR

SEQ ID NO: 6829 - protein, 1257 aa, Homo sapiens
  Payload ID: 1467;
  Gene Symbol: ARID4A;
  Gene Name: AT rich interactive domain 4A (RBP 1-like);
  Uniprot ID:  P29374;
  ENSP ID: ENSP00000347602
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSSKCTPVKHLNVSKPQKLARSPARISPHIKDGEKDKHREKHPNSSPRTYKWSFQLNELDNMNSTERISFLQEKLQEIRKYYMSLKSEVATIDRRRKRLKKKDREVSHAGASMSSASSDTGMSPSSSSPPQNVLAVECR

SEQ ID NO: 6830 - protein, 1203 aa, Homo sapiens
  Payload ID: 1467;
  Gene Symbol: ARID4A;
  Gene Name: AT rich interactive domain 4A (RBP 1-like);
  Uniprot ID:  P29374;
  ENSP ID: ENSP00000378597
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSNELDNMNSTERISFLQEKLQEIRKYYMSLKSEVATIDRRRKRLKKKDREVSHAGASMSSASSDTGMSPSSSSPPQNVLAVECR

SEQ ID NO: 6831 - protein, 265 aa, Homo sapiens
  Payload ID: 1467;
  Gene Symbol: ARID4A;
  Gene Name: AT rich interactive domain 4A (RBP 1-like);
  ENSP ID: ENSP00000392567
MKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEV

SEQ ID NO: 6832 - protein, 1188 aa, Homo sapiens; identical to SEQ ID NO: 6828
  Payload ID: 1467;
  Gene Symbol: ARID4A;
  Gene Name: AT rich interactive domain 4A (RBP 1-like);
  Uniprot ID:  P29374;
  ENSP ID: ENSP00000397368

SEQ ID NO: 6833 - protein, 40 aa, Homo sapiens
  Payload ID: 1467;
  Gene Symbol: ARID4A;
  Gene Name: AT rich interactive domain 4A (RBP 1-like);
  ENSP ID: ENSP00000410417
MKAADEPAYLTVGTDVSAKYRGAFCEAKIKTVKRLVKVKN

SEQ ID NO: 6834 - protein, 54 aa, Homo sapiens
  Payload ID: 1467;
  Gene Symbol: ARID4A;
  Gene Name: AT rich interactive domain 4A (RBP 1-like);
  ENSP ID: ENSP00000415872
MKAADEPAYLTVGTDVSAKYRGAFCEAKIKTVKRLVKVKVLLKQDNTTQLVQDD

SEQ ID NO: 6835 - protein, 748 aa, Homo sapiens
  Payload ID: 1467;
  Gene Symbol: ARID4A;
  Gene Name: AT rich interactive domain 4A (RBP 1-like);
  ENSP ID: ENSP00000416053
MEDRGTPINKPPVLGYKDLNLFKLFRLVYHQGGCDNIDSGAVWKQIYMDLGIPILNSAASYNVKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVRYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKTEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREK

SEQ ID NO: 6836 - protein, 1312 aa, Homo sapiens
  Payload ID: 1468;
  Gene Symbol: ARID4B;
  Gene Name: AT rich interactive domain 4B (RBP 1-like);
  Uniprot ID:  Q4LE39;
  ENSP ID: ENSP00000264183
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 6837 - protein, 1226 aa, Homo sapiens
  Payload ID: 1468;
  Gene Symbol: ARID4B;
  Gene Name: AT rich interactive domain 4B (RBP 1-like);
  Uniprot ID:  Q4LE39;
  ENSP ID: ENSP00000264184
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMSVECR

SEQ ID NO: 6838 - protein, 1312 aa, Homo sapiens; identical to SEQ ID NO: 6836
  Payload ID: 1468;
  Gene Symbol: ARID4B;
  Gene Name: AT rich interactive domain 4B (RBP 1-like);
  Uniprot ID:  Q4LE39;
  ENSP ID: ENSP00000355562

SEQ ID NO: 6839 - protein, 483 aa, Homo sapiens
  Payload ID: 1468;
  Gene Symbol: ARID4B;
  Gene Name: AT rich interactive domain 4B (RBP 1-like);
  ENSP ID: ENSP00000391497
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHS

SEQ ID NO: 6840 - protein, 1153 aa, Homo sapiens
  Payload ID: 1468;
  Gene Symbol: ARID4B;
  Gene Name: AT rich interactive domain 4B (RBP 1-like);
  Uniprot ID:  Q4LE39;
  ENSP ID: ENSP00000394663
MKALDEPPYLTVGTDVSAKYRGAFCEAKIKTAKRLVKVKVTFRHDSSTVEVQDDHIKGPLKVGAIVEVKNLDGAYQEAVINKLTDASWYTVVFDDGDEKTLRRSSLCLKGERHFAESETLDQLPLTNPEHFGTPVIGKKTNRGRRSNHIPEEESSSSSSDEDEDDRKQIDELLGKVVCVDYISLDKKKALWFPALVVCPDCSDEIAVKKDNILVRSFKDGKFTSVPRKDVHEITSDTAPKPDAVLKQAFEQALEFHKSRTIPANWKTELKEDSSSSEAEEEEEEEDDEKEKEDNSSEEEEEIEPFPEERENFLQQLYKFMEDRGTPINKRPVLGYRNLNLFKLFRLVHKLGGFDNIESGAVWKQVYQDLGIPVLNSAAGYNVKCAYKKYLYGFEEYCRSANIEFQMALPEKVVNKQCKECENVKEIKVKEENETEIKEIKMEEERNIIPREEKPIEDEIERKENIKPSLGSKKNLLESIPTHSDQEKEVNIKKPEDNENLDDKDDDTTRVDESLNIKVEAEEEKAKSGDETNKEEDEDDEEAEEEEEEEEEEEDEDDDDNNEEEEFECYPPGMKVQVRYGRGKNQKMYEASIKDSDVEGGEVLYLVHYCGWNVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGSAPH

SEQ ID NO: 6841 - protein, 553 aa, Homo sapiens
  Payload ID: 1468;
  Gene Symbol: ARID4B;
  Gene Name: AT rich interactive domain 4B (RBP 1-like);
  ENSP ID: ENSP00000416063
  MOD_RES (1)..(1): Any amino acid
XFECYPPGMKVQVRYDEWIKADKIVRPADKNVPKIKHRKKIKNKLDKEKDKDEKYSPKNCKLRRLSKPPFQTNPSPEMVSKLDLTDAKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGSKCE

SEQ ID NO: 6842 - protein, 696 aa, Homo sapiens
  Payload ID: 1468;
  Gene Symbol: ARID4B;
  Gene Name: AT rich interactive domain 4B (RBP 1-like);
  ENSP ID: ENSP00000420620
  MOD_RES (1)..(1): Any amino acid
XKNSDTAHIKSIEITSILNGLQASESSAEDSEQEDERGAQDMDNNGKEESKIDHLTNNRNDLISKEEQNSSSLLEENKVHADLVISKPVSKSPERLRKDIEVLSEDTDYEEDEVTKKRKDVKKDTTDKSSKPQIKRGKRRYCNTEECLKTGSPGKKEEKAKNKESLCMENSSNSSSDEDEEETKAKMTPTKKYNGLEEKRKSLRTTGFYSGFSEVAEKRIKLLNNSDERLQNSRAKDRKDVWSSIQGQWPKKTLKELFSDSDTEAAASPPHPAPEEGVAEESLQTVAEEESCSPSVELEKPPPVNVDSKPIEEKTVEVNDRKAEFPSSGSNSVLNTPPTTPESPSSVTVTEGSRQQSSVTVSEPLAPNQEEVRSIKSETDSTIEVDSVAGELQDLQSEGNSSPAGFDASVSSSSSNQPEPEHPEKACTGQKRVKDAQGGGSSSKKQKRSHKATVVNNKKKGKGTNSSDSEELSAGESITKSQPVKSVSTGMKSHSTKSPARTQSPGKCGKNGDKDPDLKEPSNRLPKVYKWSFQMSDLENMTSAERITILQEKLQEIRKHYLSLKSEVASIDRRRKRLKKKERESAATSSSSSSPSSSSITAAVMLTLAEPSMSSASQNGMLQPLPEDVLHSQNEAFLKRRGPPTDGDKPAPSPSASLRRRPAADCRRGGGVARERKCPEPGSASWRAAAVWESLE

SEQ ID NO: 6843 - protein, 594 aa, Homo sapiens
  Payload ID: 1469;
  Gene Symbol: ARID5A;
  Gene Name: AT rich interactive domain 5A (MRF 1-like);
  Uniprot ID:  Q03989;
  ENSP ID: ENSP00000350078
MAAPVKGNRKQSTEGDALDPPASPKPAGKQNGIQNPISLEDSPEAGGEREEEQEREEEQAFLVSLYKFMKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 6844 - protein, 58 aa, Homo sapiens
  Payload ID: 1469;
  Gene Symbol: ARID5A;
  Gene Name: AT rich interactive domain 5A (MRF 1-like);
  ENSP ID: ENSP00000397286
MAAPVKGNRKQSTEGDALDPPASPKPAGKQNGIQNPISLELTCGRSTKQWRSWGPMSW

SEQ ID NO: 6845 - protein, 526 aa, Homo sapiens
  Payload ID: 1469;
  Gene Symbol: ARID5A;
  Gene Name: AT rich interactive domain 5A (MRF 1-like);
  ENSP ID: ENSP00000400785
MKERHTPIERVPHLGFKQINLWKIYKAVEKLGAYELVTGRRLWKNVYDELGGSPGSTSAATCTRRHYERLVLPYVRHLKGEDDKPLPTSKPRKQYKMAKENRGDDGATERPKKAKEERRMDQMMPGKTKADAADPAPLPSQEPPRNSTEQQGLASGSSVSFVGASGCPEAYKRLLSSFYCKGTHGIMSPLAKKKLLAQVSKVEALQCQEEGCRHGAEPQASPAVHLPESPQSPKGLTENSRHRLTPQEGLQAPGGSLREEAQAGPCPAAPIFKGCFYTHPTEVLKPVSQHPRDFFSRLKDGVLLGPPGKEGLSVKEPQLVWGGDANRPSAFHKGGSRKGILYPKPKACWVSPMAKVPAESPTLPPTFPSSPGLGSKRSLEEEGAAHSGKRLRAVSPFLKEADAKKCGAKPAGSGLVSCLLGPALGPVPPEAYRGTMLHCPLNFTGTPGPLKGQAALPFSPLVIPAFPAHFLATAGPSPMAAGLMHFPPTSFDSALRHRLCPASSAWHAPPVTTYAAPHFFHLNTKL

SEQ ID NO: 6846 - protein, 1188 aa, Homo sapiens
  Payload ID: 1470;
  Gene Symbol: ARID5B;
  Gene Name: AT rich interactive domain 5B (MRF 1-like);
  Uniprot ID:  Q14865;
  ENSP ID: ENSP00000279873
MEPNSLQWVGSPCGLHGPYIFYKAFQFHLEGKPRILSLGDFFFVRCTPKDPICIAELQLLWEERTSRQLLSSSKLYFLPEDTPQGRNSDHGEDEVIAVSEKVIVKLEDLVKWVHSDFSKWRCGFHAGPVKTEALGRNGQKEALLKYRQSTLNSGLNFKDVLKEKADLGEDEEETNVIVLSYPQYCRYRSMLKRIQDKPSSILTDQFALALGGIAVVSRNPQILYCRDTFDHPTLIENESICDEFAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASLSSSYPYGSPPPLISKKKLIARDDLCSSLSQTHHGQSTDHMAVSRPSVIQHVQSFRSKPSEERKTINDIFKHEKLSRSDPHRCSFSKHHLNPLADSYVLKQEIQEGKDKLLEKRALPHSHMPSFLADFYSSPHLHSLYRHTEHHLHNEQTSKYPSRDMYRESENSSFPSHRHQEKLHVNYLTSLHLQDKKSAAAEAPTDDQPTDLSLPKNPHKPTGKVLGLAHSTTGPQESKGISQFQVLGSQSRDCHPKACRVSPMTMSGPKKYPESLSRSGKPHHVRLENFRKMEGMVHPILHRKMSPQNIGAARPIKRSLEDLDLVIAGKKARAVSPLDPSKEVSGKEKASEQESEGSKAAHGGHSGGGSEGHKLPLSSPIFPGLYSGSLCNSGLNSRLPAGYSHSLQYLKNQTVLSPLMQPLAFHSLVMQRGIFTSPTNSQQLYRHLAAATPVGSSYGDLLHNSIYPLAAINPQAAFPSSQLSSVHPSTKL

SEQ ID NO: 6847 - protein, 945 aa, Homo sapiens
  Payload ID: 1470;
  Gene Symbol: ARID5B;
  Gene Name: AT rich interactive domain 5B (MRF 1-like);
  Uniprot ID:  Q14865;
  ENSP ID: ENSP00000308862
MAPNLKGRPRKKKPCPQRRDSFSGVKDSNNNSDGKAVAKVKCEARSALTKPKNNHNCKKVSNEEKPKVAIGEECRADEQAFLVALYKYMKERKTPIERIPYLGFKQINLWTMFQAAQKLGGYETITARRQWKHIYDELGGNPGSTSAATCTRRHYERLILPYERFIKGEEDKPLPPIKPRKQENSSQENENKTKVSGTKRIKHEIPKSKKEKENAPKPQDAAEVSSEQEKEQETLISQKSIPEPLPAADMKKKIEGYQEFSAKPLASRVDPEKDNETDQGSNSEKVAEEAGEKGPTPPLPSAPLAPEKDSALVPGASKQPLTSPSALVDSKQESKLCCFTESPESEPQEASFPSFPTTQPPLANQNETEDDKLPAMADYIANCTVKVDQLGSDDIHNALKQTPKVLVVQSFDMFKDKDLTGPMNENHGLNYTPLLYSRGNPGIMSPLAKKKLLSQVSGASLSSSYPYGSPPPLISKKKLIARDDLCSSLSQTHHGQSTDHMAVSRPSVIQHVQSFRSKPSEERKTINDIFKHEKLSRSDPHRCSFSKHHLNPLADSYVLKQEIQEGKDKLLEKRALPHSHMPSFLADFYSSPHLHSLYRHTEHHLHNEQTSKYPSRDMYRESENSSFPSHRHQEKLHVNYLTSLHLQDKKSAAAEAPTDDQPTDLSLPKNPHKPTGKVLGLAHSTTGPQESKGISQFQVLGSQSRDCHPKACRVSPMTMSGPKKYPESLSRSGKPHHVRLENFRKMEGMVHPILHRKMSPQNIGAARPIKRSLEDLDLVIAGKKARAVSPLDPSKEVSGKEKASEQESEGSKAAHGGHSGGGSEGHKLPLSSPIFPGLYSGSLCNSGLNSRLPAGYSHSLQYLKNQTVLSPLMQPLAFHSLVMQRGIFTSPTNSQQLYRHLAAATPVGSSYGDLLHNSIYPLAAINPQAAFPSSQLSSVHPSTKL

SEQ ID NO: 6848 - protein, 371 aa, Homo sapiens
  Payload ID: 1471;
  Gene Symbol: ATCAY;
  Gene Name: ataxia, cerebellar, Cayman type;
  Uniprot ID:  Q86WG3;
  ENSP ID: ENSP00000390941
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETSMS

SEQ ID NO: 6849 - protein, 377 aa, Homo sapiens
  Payload ID: 1471;
  Gene Symbol: ATCAY;
  Gene Name: ataxia, cerebellar, Cayman type;
  Uniprot ID:  Q86WG3;
  ENSP ID: ENSP00000470842
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIETPDETDSLEFLGNGNELEWEDDTPVATAKNMPGDSADLFGDGTTEDGSAANGRLWRTVIIGEQEHRIDLHMIRPYMKVVTHGGYYGEGLNAIIVFAACFLPDSSLPDYHYIMENLFLYVISSLELLVAEDYMIVYLNGATPRRRMPGIGWLKKCYQMIDRRLRKNLKSLIIVHPSWFIRTVLAISRPFISVKFINKIQYVHSLEDLEQLIPMEHVQIPDCVLQYEEERLKARRESARPQPEFVLPRSEEKPEVAPVENRSALVSEDQETSLQPLHRSS

SEQ ID NO: 6850 - protein, 99 aa, Homo sapiens
  Payload ID: 1471;
  Gene Symbol: ATCAY;
  Gene Name: ataxia, cerebellar, Cayman type;
  ENSP ID: ENSP00000471731
MGTTEATLRMENVDVKEEWQDEDLPRPLPEETGVELLGSPVEDTSSPPNTLNFNGAHRKRKTLVAPEINISLDQSEGSLLSDDFLDTPDDLDINVDDIE

SEQ ID NO: 6851 - protein, 74 aa, Homo sapiens
  Payload ID: 1471;
  Gene Symbol: ATCAY;
  Gene Name: ataxia, cerebellar, Cayman type;
  ENSP ID: ENSP00000472263
MGTTEATLRMENVDVKEEWQDEDLPSQELLCTILGTTKSKIHRAGWKLSGHSQKRRGWNCLAARWKTHPLLPTR

SEQ ID NO: 6852 - protein, 815 aa, Homo sapiens
  Payload ID: 1472;
  Gene Symbol: ATXN1;
  Gene Name: ataxin 1;
  Uniprot ID:  P54253;
  ENSP ID: ENSP00000244769
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGK

SEQ ID NO: 6853 - protein, 815 aa, Homo sapiens; identical to SEQ ID NO: 6852
  Payload ID: 1472;
  Gene Symbol: ATXN1;
  Gene Name: ataxin 1;
  Uniprot ID:  P54253;
  ENSP ID: ENSP00000416360

SEQ ID NO: 6854 - protein, 475 aa, Homo sapiens
  Payload ID: 1473;
  Gene Symbol: ATXN10;
  Gene Name: ataxin 10;
  Uniprot ID:  Q9UBB4;
  ENSP ID: ENSP00000252934
MAAPRPPPARLSGVMVPAPIQDLEALRALTALFKEQRNRETAPRTIFQRVLDILKKSSHAVELACRDPSQVENLASSLQLITECFRCLRNACIECSVNQNSIRNLDTIGVAVDLILLFRELRVEQESLLTAFRCGLQFLGNIASRNEDSQSIVWVHAFPELFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 6855 - protein, 411 aa, Homo sapiens
  Payload ID: 1473;
  Gene Symbol: ATXN10;
  Gene Name: ataxin 10;
  Uniprot ID:  Q9UBB4;
  ENSP ID: ENSP00000370449
MAAPRPPPARLSGVMVPAPIQDLEALRALTALFKEQRNRNLDTIGVAVDLILLFRELRVEQESLLTAFRCGLQFLGNIASRNEDSQSIVWVHAFPELFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 6856 - protein, 126 aa, Homo sapiens
  Payload ID: 1473;
  Gene Symbol: ATXN10;
  Gene Name: ataxin 10;
  ENSP ID: ENSP00000385624
MQVPQHLKRSHQSHSSMLRPSCLLLRSSCHPRFLPFPSDAGQVNELDGIPLILDNCNISDSNPFLTQWVIYAIRNLTEDNSQNQDLIAKMEEQGLADASLLKKVGFEVEKKGEKLILKSTRDTPKP

SEQ ID NO: 6857 - protein, 197 aa, Homo sapiens
  Payload ID: 1473;
  Gene Symbol: ATXN10;
  Gene Name: ataxin 10;
  ENSP ID: ENSP00000391117
LMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPYVCTHHPDGNTEHAHLPRRLLECPVSLTANPQM

SEQ ID NO: 6858 - protein, 689 aa, Homo sapiens
  Payload ID: 1474;
  Gene Symbol: ATXN1L;
  Gene Name: ataxin 1-like;
  Uniprot ID:  P0C7T5;
  ENSP ID: ENSP00000415822
MKPVHERSQECLPPKKRDLPVTSEDMGRTTSCSTNHTPSSDASEWSRGVVVAGQSQAGARVSLGGDGAEAITGLTVDQYGMLYKVAVPPATFSPTGLPSVVNMSPLPPTFNVASSLIQHPGIHYPPLHYAQLPSTSLQFIGSPYSLPYAVPPNFLPSPLLSPSANLATSHLPHFVPYASLLAEGATPPPQAPSPAHSFNKAPSATSPSGQLPHHSSTQPLDLAPGRMPIYYQMSRLPAGYTLHETPPAGASPVLTPQESQSALEAAAANGGQRPRERNLVRRESEALDSPNSKGEGQGLVPVVECVVDGQLFSGSQTPRVEVAAPAHRGTPDTDLEVQRVVGALASQDYRVVAAQRKEEPSPLNLSHHTPDHQGEGRGSARNPAELAEKSQARGFYPQSHQEPVKHRPLPKAMVVANGNLVPTGTDSGLLPVGSEILVASSLDVQARATFPDKEPTPPPITSSHLPSHFMKGAIIQLATGELKRVEDLQTQDFVRSAEVSGGLKIDSSTVVDIQESQWPGFVMLHFVVGEQQSKVSIEVPPEHPFFVYGQGWSSCSPGRTTQLFSLPCHRLQVGDVCISISLQSLNSNSVSQASCAPPSQLGPPRERPERTVLGSRELCDSEGKSQPAGEGSRVVEPSQPESGAQACWPAPSFQRYSMQGEEARAALLRPSFIPQEVKLSIEGRSNAGK

SEQ ID NO: 6859 - protein, 1313 aa, Homo sapiens
  Payload ID: 1475;
  Gene Symbol: ATXN2;
  Gene Name: ataxin 2;
  Uniprot ID:  Q99700;
  ENSP ID: ENSP00000366843
MRSAAAAPRSPAVATESRRFAAARWPGWRSLQRPARRSGRGGGGAAPGPYPSAAPPPPGPGPPPSRQSSPPSASDCFGSNGNGGGAFRPGSRRLLGLGGPPRPFVVLLLPLASPGAPPAAPTRASPLGARASPPRSGVSLARPAPGCPRPACEPVYGPLTMSLKPQQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 6860 - protein, 1050 aa, Homo sapiens
  Payload ID: 1475;
  Gene Symbol: ATXN2;
  Gene Name: ataxin 2;
  ENSP ID: ENSP00000373805
MRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAGKVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 6861 - protein, 424 aa, Homo sapiens
  Payload ID: 1475;
  Gene Symbol: ATXN2;
  Gene Name: ataxin 2;
  ENSP ID: ENSP00000373806
PSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAGKVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQYKPTTNSSCKAALEEPKGQIPSSLLLLLPTGSTEN

SEQ ID NO: 6862 - protein, 1006 aa, Homo sapiens
  Payload ID: 1475;
  Gene Symbol: ATXN2;
  Gene Name: ataxin 2;
  Uniprot ID:  Q99700;
  ENSP ID: ENSP00000439338
MRMVHILTSVVCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYVSTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 6863 - protein, 1073 aa, Homo sapiens
  Payload ID: 1475;
  Gene Symbol: ATXN2;
  Gene Name: ataxin 2;
  ENSP ID: ENSP00000445583
MRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQCASEALARCGLEMRLSWIYLSEGYLAHVQSGMVPSHPTAHAPMMLMTTQPPGGPQAALAQSALQPIPVSTTAHFPYMTHPSVQAHHQQQL

SEQ ID NO: 6864 - protein, 916 aa, Homo sapiens
  Payload ID: 1475;
  Gene Symbol: ATXN2;
  Gene Name: ataxin 2;
  ENSP ID: ENSP00000446512
  MOD_RES (1)..(1): Any amino acid
XGNGGGAFRPGSRRLLGLGGPPRPFVVLLLPLASPGAPPAAPTRASPLGARASPPRSGVSLARPAPGCPRPACEPVYGPLTMSLKPQQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQYQICPNSGKTSIIRVP

SEQ ID NO: 6865 - protein, 1313 aa, Homo sapiens; identical to SEQ ID NO: 6859
  Payload ID: 1475;
  Gene Symbol: ATXN2;
  Gene Name: ataxin 2;
  Uniprot ID:  Q99700;
  ENSP ID: ENSP00000446576

SEQ ID NO: 6866 - protein, 296 aa, Homo sapiens
  Payload ID: 1475;
  Gene Symbol: ATXN2;
  Gene Name: ataxin 2;
  ENSP ID: ENSP00000447225
  MOD_RES (1)..(1): Any amino acid
XSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNA

SEQ ID NO: 6867 - protein, 196 aa, Homo sapiens
  Payload ID: 1475;
  Gene Symbol: ATXN2;
  Gene Name: ataxin 2;
  ENSP ID: ENSP00000447741
HPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQVIPALANFL

SEQ ID NO: 6868 - protein, 235 aa, Homo sapiens
  Payload ID: 1475;
  Gene Symbol: ATXN2;
  Gene Name: ataxin 2;
  ENSP ID: ENSP00000448640
  MOD_RES (1)..(1): Any amino acid
XRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGPPRMSPKAQRHPRNHRVSAGRGSISSGLEFVSHNPPSEAATPPVARTSPSGGTWSSVVSGAKDSRLQDQRQNSPAGNKENIKPNETS

SEQ ID NO: 6869 - protein, 184 aa, Homo sapiens
  Payload ID: 1475;
  Gene Symbol: ATXN2;
  Gene Name: ataxin 2;
  ENSP ID: ENSP00000449566
MLGERDCSRGRGRVPEGRKGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARA

SEQ ID NO: 6870 - protein, 107 aa, Homo sapiens
  Payload ID: 1475;
  Gene Symbol: ATXN2;
  Gene Name: ataxin 2;
  ENSP ID: ENSP00000474442
  MOD_RES (1)..(1): Any amino acid
XQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAALEHMNLLKELCLK

SEQ ID NO: 6871 - protein, 119 aa, Homo sapiens
  Payload ID: 1475;
  Gene Symbol: ATXN2;
  Gene Name: ataxin 2;
  ENSP ID: ENSP00000474645
AQQTVFTIHPSHVQPAYTNPPHMAHVPQAHVQSGMVPSHPTAHAPMMLMTTQPPGGPQAALAQSALQPIPVSTTAHFPYMTHPSGEACVCRGRRGTPKHSARTGGMAGRASASSPAFEN

SEQ ID NO: 6872 - protein, 1153 aa, Homo sapiens
  Payload ID: 1475;
  Gene Symbol: ATXN2;
  Gene Name: ataxin 2;
  ENSP ID: ENSP00000476504
MSLKPQQQQQQQQQQQQQQQQQQQQQQQPPPAAANVRKPGGSGLLASPAAAPSPSSSSVSSSSATAPSSVVAATSGGGRPGLGRGRNSNKGLPQSTISFDGIYANMRMVHILTSVVGSKCEVQVKNGGIYEGVFKTYSPKCDLVLDAAHEKSTESSSGPKREEIMESILFKCSDFVVVQFKDMDSSYAKRDAFTDSAISAKVNGEHKEKDLEPWDAGELTANEELEALENDVSNGWDPNDMFRYNEENYGVVSTYDSSLSSYTVPLERDNSEEFLKREARANQLAEEIESSAQYKARVALENDDRSEEEKYTAVQRNSSEREGHSINTRENKYIPPGQRNREVISWGSGRQNSPRMGQPGSGSMPSRSTSHTSDFNPNSGSDQRVVNGGVPWPSPCPSPSSRPPSRYQSGPNSLPPRAATPTRPPSRPPSRPSRPPSHPSAHGSPAPVSTMPKRMSSEGPPRMSPKAQRHPRNHRVSAGRGSISSGLEFVSHNPPSEAATPPVARTSPSGGTWSSVVSGVPRLSPKTHRPRSPRQNSIGNTPSGPVLASPQAGIIPTEAVAMPIPAASPTPASPASNRAVTPSSEAKDSRLQDQRQNSPAGNKENIKPNETSPSFSKAENKGISPVVSEHRKQIDDLKKFKNDFRLQPSSTSESMDQLLNKNREGEKSRDLIKDKIEPSAKDSFIENSSSNCTSGSSKPNSPSISPSILSNTEHKRGPEVTSQGVQTSSPACKQEKDDKEEKKDAAEQVRKSTLNPNAKEFNPRSFSQPKPSTTPTSPRPQAQPSPSMVGHQQPTPVYTQPVCFAPNMMYPVPVSPGVQPLYPIPMTPMPVNQAKTYRAVPNMPQQRQDQHHQSAMMHPASAAGPPIAATPPAYSTQYVAYSPQQFPNQPLVQHVPHYQSQHPHVYSPVIQGNARMMAPPTHAQPGLVSSSATQYGAHEQTHAMYACPKLPYNKETSPSFYFAISTGSLAQQYAHPNATLHPHTPHPQPSATPTGQQQSQHGGSHPAPSPVQHHQHQAAQALHLASPQQQSAIYHAGLAPTPPSMTPASNTQSPQNSFPAAQQTVFTIHPSHVQPAYTNPPHMAHVPQAHVQSGMVPSHPTAHAPMMLMTTQPPGGPQAALAQSALQPIPVSTTAHFPYMTHPSVQAHHQQQL

SEQ ID NO: 6873 - protein, 1006 aa, Homo sapiens; identical to SEQ ID NO: 6862
  Payload ID: 1475;
  Gene Symbol: ATXN2;
  Gene Name: ataxin 2;
  Uniprot ID:  Q99700;
  ENSP ID: ENSP00000481448

SEQ ID NO: 6874 - protein, 1062 aa, Homo sapiens
  Payload ID: 1476;
  Gene Symbol: ATXN2L;
  Gene Name: ataxin 2-like;
  Uniprot ID:  Q8WWM7;
  ENSP ID: ENSP00000315650
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIPPLPPPGELKIVLAAT

SEQ ID NO: 6875 - protein, 1075 aa, Homo sapiens
  Payload ID: 1476;
  Gene Symbol: ATXN2L;
  Gene Name: ataxin 2-like;
  Uniprot ID:  Q8WWM7;
  ENSP ID: ENSP00000338718
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 6876 - protein, 1044 aa, Homo sapiens
  Payload ID: 1476;
  Gene Symbol: ATXN2L;
  Gene Name: ataxin 2-like;
  Uniprot ID:  Q8WWM7;
  ENSP ID: ENSP00000341459
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQVQSHPSQQLPFHPPGN

SEQ ID NO: 6877 - protein, 1044 aa, Homo sapiens
  Payload ID: 1476;
  Gene Symbol: ATXN2L;
  Gene Name: ataxin 2-like;
  Uniprot ID:  Q8WWM7;
  ENSP ID: ENSP00000372133
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQAPLPPPGELKIVLAAT

SEQ ID NO: 6878 - protein, 1097 aa, Homo sapiens
  Payload ID: 1476;
  Gene Symbol: ATXN2L;
  Gene Name: ataxin 2-like;
  Uniprot ID:  Q8WWM7;
  ENSP ID: ENSP00000378917
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRILCRVGRSHSRRRQGLAPGSVLCFPPSSLSCDPAAPLPTASPALSDPDCLLT

SEQ ID NO: 6879 - protein, 1062 aa, Homo sapiens
  Payload ID: 1476;
  Gene Symbol: ATXN2L;
  Gene Name: ataxin 2-like;
  Uniprot ID:  Q8WWM7;
  ENSP ID: ENSP00000454516
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRILQSHPSQQLPFHPPGN

SEQ ID NO: 6880 - protein, 187 aa, Homo sapiens
  Payload ID: 1476;
  Gene Symbol: ATXN2L;
  Gene Name: ataxin 2-like;
  ENSP ID: ENSP00000454588
  MOD_RES (1)..(1): Any amino acid
XTSGSHPQAIVSSSTPQYPSAEQPTPQALYATVHQSYPHHATQLHAHQPQPATTPTGSQPQSQHAAPSPVQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPAL

SEQ ID NO: 6881 - protein, 401 aa, Homo sapiens
  Payload ID: 1476;
  Gene Symbol: ATXN2L;
  Gene Name: ataxin 2-like;
  ENSP ID: ENSP00000454757
NKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 6882 - protein, 110 aa, Homo sapiens
  Payload ID: 1476;
  Gene Symbol: ATXN2L;
  Gene Name: ataxin 2-like;
  ENSP ID: ENSP00000455427
QSSFPQPAAVYAIHHQQLPHGFTNMAHVTQAHVQTGITAAPPPHPGAPHPPQVMLLHPPQSHGGPPQGAVPQSGVPALSASTPSPYPYIGHPQAAPLPPPGELKIVLAAT

SEQ ID NO: 6883 - protein, 11 aa, Homo sapiens
  Payload ID: 1476;
  Gene Symbol: ATXN2L;
  Gene Name: ataxin 2-like;
  ENSP ID: ENSP00000455560
  MOD_RES (1)..(1): Any amino acid
XALSDPDCLLT

SEQ ID NO: 6884 - protein, 128 aa, Homo sapiens
  Payload ID: 1476;
  Gene Symbol: ATXN2L;
  Gene Name: ataxin 2-like;
  ENSP ID: ENSP00000455981
  MOD_RES (1)..(1): Any amino acid
XNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQALSDPDCLLT

SEQ ID NO: 6885 - protein, 400 aa, Homo sapiens
  Payload ID: 1476;
  Gene Symbol: ATXN2L;
  Gene Name: ataxin 2-like;
  ENSP ID: ENSP00000456162
NKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRIREFSLAGGIWHGRAEGLQVGQDARVLGGE

SEQ ID NO: 6886 - protein, 336 aa, Homo sapiens
  Payload ID: 1476;
  Gene Symbol: ATXN2L;
  Gene Name: ataxin 2-like;
  ENSP ID: ENSP00000456752
MAFAAALSPSPASGPLFALNRRLHQPATSRVTWRLVIPAEGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGS

SEQ ID NO: 6887 - protein, 91 aa, Homo sapiens
  Payload ID: 1476;
  Gene Symbol: ATXN2L;
  Gene Name: ataxin 2-like;
  ENSP ID: ENSP00000456812
MLHFLTAVVGSTCDVKVKNGTTYEGIFKTLSSKFELAVDAVHRKASEPAGGPRREDIVDTMVFKPSDVMLVHFRNVDFNYATKDKFTDSAI

SEQ ID NO: 6888 - protein, 217 aa, Homo sapiens
  Payload ID: 1476;
  Gene Symbol: ATXN2L;
  Gene Name: ataxin 2-like;
  ENSP ID: ENSP00000457599
GSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKKRTTQKSFVSESCVRPSWLERLNQAPSTAYGSPWRTTMGALKRRSTVQSSGRAQGGRAPAWHPGRGSISLCLNESGKVPGEEFDAAALGAVGLALALCHLVALTIWTTAALAQVLRPVVSME

SEQ ID NO: 6889 - protein, 1068 aa, Homo sapiens
  Payload ID: 1476;
  Gene Symbol: ATXN2L;
  Gene Name: ataxin 2-like;
  ENSP ID: ENSP00000457613
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNEMFKFNEENYGVKTTYDSSLSSYTVPLEKDNSEEFRQRELRAAQLAREIESSPQYRLRIAMENDDGRTEEEKHSAVQRQGSGRESPSLASREGKYIPLPQRVREGPRGGVRCSSSRGGRPGLSSLPPRGPHHLDNSSPGPGSEARGINGGPSRMSPKAQRPLRGAKTLSSPSNRPSGETSVPPPPAAPPFLPVGRMYPPRSPKSAAPAPISASCPEPPIGSAVPTSSASIPVTSSVSDPGVGSISPASPKISLAPTDVKELSTKEPGRTLEPQELARIAGKVPGLQNEQKRFQLEELRKFGAQFKLQPSSSPENSLDPFPPRILKEEPKGKEKEVDGLLTSEPMGSPVSSKTESVSDKEDKPPLAPSGGTEGPEQPPPPCPSQTGSPPVGLIKGEDKDEGPVAEQVKKSTLNPNAKEFNPTKPLLSVNKSTSTPTSPGPRTHSTPSIPVLTAGQSGLYSPQYISYIPQIHMGPAVQAPQMYPYPVSNSVPGQQGKYRGAKGSLPPQRSDQHQPASAPPMMQAAAAAGPPLVAATPYSSYIPYNPQQFPGQPAMMQPMAHYPSQPVFAPMLQSNPRMLTSGSHPQAIVSSSTPQYPSAEQPTPQALYATVHQSYPHHATQLHAHQPQPATTPTGSQPQSQHAAPSPVQHQAGQAPHLGSGQPQQNLYHPGALTGTPPSLPPGPSAQSPQSSFPQPAAVYAIHHQQLPHGFTNMAHVTQAHVQTGITAAPPPHPGAPHPPQVMLLHPPQSHGGPPQGAVPQSGVPALSASTPSPYPYIGHPQGEQPGQAPGFPGGADDRILQSHPSQQLPFHPPGN

SEQ ID NO: 6890 - protein, 306 aa, Homo sapiens
  Payload ID: 1477;
  Gene Symbol: ATXN3;
  Gene Name: ataxin 3;
  Uniprot ID:  P54252;
  ENSP ID: ENSP00000339110
MESIFHEKQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 6891 - protein, 79 aa, Homo sapiens
  Payload ID: 1477;
  Gene Symbol: ATXN3;
  Gene Name: ataxin 3;
  ENSP ID: ENSP00000352324
MESIFHEKQEGSLCAQHCLNNLLQGEYFSPVELSSIAHQLDEEERMRMAEGGVTSEDYRTFLQQPSGNMDDSGFFSIQK

SEQ ID NO: 6892 - protein, 310 aa, Homo sapiens
  Payload ID: 1477;
  Gene Symbol: ATXN3;
  Gene Name: ataxin 3;
  ENSP ID: ENSP00000376965
MESIFHEKQEGSLCAQHCLNNLLQGEYFSPVELSSIAHQLDEEERMRMAEGGVTSEDYRTFLQQPSGNMDDSGFFSIQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 6893 - protein, 291 aa, Homo sapiens
  Payload ID: 1477;
  Gene Symbol: ATXN3;
  Gene Name: ataxin 3;
  ENSP ID: ENSP00000389376
MESIFHEKVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 6894 - protein, 99 aa, Homo sapiens
  Payload ID: 1477;
  Gene Symbol: ATXN3;
  Gene Name: ataxin 3;
  ENSP ID: ENSP00000422073
MESIFHEKQEGSLCAQHCLNNLLQGEYFSPVELSSIAHQLDEEERMRMAEGGVTSEDYRTFLQQPSGNMDDSGFFSIQVILYLSLRVICQIAKLTNSCR

SEQ ID NO: 6895 - protein, 182 aa, Homo sapiens
  Payload ID: 1477;
  Gene Symbol: ATXN3;
  Gene Name: ataxin 3;
  Uniprot ID:  P54252;
  ENSP ID: ENSP00000425322
MIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 6896 - protein, 346 aa, Homo sapiens
  Payload ID: 1477;
  Gene Symbol: ATXN3;
  Gene Name: ataxin 3;
  Uniprot ID:  P54252;
  ENSP ID: ENSP00000426697
MESIFHEKQEGSLCAQHCLNNLLQGEYFSPVELSSIAHQLDEEERMRMAEGGVTSEDYRTFLQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 6897 - protein, 205 aa, Homo sapiens
  Payload ID: 1477;
  Gene Symbol: ATXN3;
  Gene Name: ataxin 3;
  ENSP ID: ENSP00000435571
MESIFHEKQEGSLCAQHCLNNLLQGEYFSPVELSSIAHQLDEEERMRMAEGGVTSEDYRTFLQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQT

SEQ ID NO: 6898 - protein, 364 aa, Homo sapiens
  Payload ID: 1477;
  Gene Symbol: ATXN3;
  Gene Name: ataxin 3;
  Uniprot ID:  P54252;
  ENSP ID: ENSP00000437157
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGKACSPFIMFATFTLYLTYELHVIFALHYSSFPL

SEQ ID NO: 6899 - protein, 370 aa, Homo sapiens
  Payload ID: 1477;
  Gene Symbol: ATXN3;
  Gene Name: ataxin 3;
  ENSP ID: ENSP00000445618
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKVRLRLQKYIQQQKQQQQQQQQQQGDLSGQSSHPCERPATSSGALGSDLGDAMSEEDMLQAAVTMSLETVRNDLKTEGKK

SEQ ID NO: 6900 - protein, 79 aa, Homo sapiens; identical to SEQ ID NO: 6891
  Payload ID: 1477;
  Gene Symbol: ATXN3;
  Gene Name: ataxin 3;
  ENSP ID: ENSP00000450492

SEQ ID NO: 6901 - protein, 79 aa, Homo sapiens; identical to SEQ ID NO: 6891
  Payload ID: 1477;
  Gene Symbol: ATXN3;
  Gene Name: ataxin 3;
  ENSP ID: ENSP00000450566

SEQ ID NO: 6902 - protein, 223 aa, Homo sapiens
  Payload ID: 1477;
  Gene Symbol: ATXN3;
  Gene Name: ataxin 3;
  ENSP ID: ENSP00000450641
MESIFHEKQPSGNMDDSGFFSIQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSD

SEQ ID NO: 6903 - protein, 151 aa, Homo sapiens
  Payload ID: 1477;
  Gene Symbol: ATXN3;
  Gene Name: ataxin 3;
  ENSP ID: ENSP00000450642
MIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDL

SEQ ID NO: 6904 - protein, 260 aa, Homo sapiens
  Payload ID: 1477;
  Gene Symbol: ATXN3;
  Gene Name: ataxin 3;
  ENSP ID: ENSP00000451001
MESIFHEKVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDL

SEQ ID NO: 6905 - protein, 110 aa, Homo sapiens
  Payload ID: 1477;
  Gene Symbol: ATXN3;
  Gene Name: ataxin 3;
  ENSP ID: ENSP00000451103
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPIGLT

SEQ ID NO: 6906 - protein, 78 aa, Homo sapiens
  Payload ID: 1477;
  Gene Symbol: ATXN3;
  Gene Name: ataxin 3;
  ENSP ID: ENSP00000451132
MESIFHEKQEGSLCAQHCLNNLLQGEYFSPVELSSIAHQLDEEERMRMAEGGVTSEDYRTFLQPSGNMDDSGFFSIQK

SEQ ID NO: 6907 - protein, 329 aa, Homo sapiens
  Payload ID: 1477;
  Gene Symbol: ATXN3;
  Gene Name: ataxin 3;
  ENSP ID: ENSP00000451385
MESIFHEKQEGSLCAQHCLNNLLQGEYFSPVELSSIAHQLDEEERMRMAEGGVTSEDYRTFLQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDL

SEQ ID NO: 6908 - protein, 114 aa, Homo sapiens
  Payload ID: 1477;
  Gene Symbol: ATXN3;
  Gene Name: ataxin 3;
  ENSP ID: ENSP00000451399
MESIFHEKQEGSLCAQHCLNNLLQGEYFSPVELSSIAHQLDEEERMRMAEGGVTSEDYRTFLQQPSGNMDDSGFFSIQLLFFLTGYKQCLESLGFRTNPVQQSRVSEAQDRSYK

SEQ ID NO: 6909 - protein, 95 aa, Homo sapiens
  Payload ID: 1477;
  Gene Symbol: ATXN3;
  Gene Name: ataxin 3;
  ENSP ID: ENSP00000451405
MESIFHEKQPSGNMDDSGFFSIQVISNALKVWGLELILFNSPEYQRLRIDPINERSFICNYKEHWFTVRKLGKQVILYLSLRVICQIAKLTNSCR

SEQ ID NO: 6910 - protein, 232 aa, Homo sapiens
  Payload ID: 1477;
  Gene Symbol: ATXN3;
  Gene Name: ataxin 3;
  ENSP ID: ENSP00000451417
MTVVFSLFRNERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDL

SEQ ID NO: 6911 - protein, 110 aa, Homo sapiens
  Payload ID: 1477;
  Gene Symbol: ATXN3;
  Gene Name: ataxin 3;
  ENSP ID: ENSP00000451693
MESIFHEKQEGSLCAQHCLNNLLQGEYFSPVELSSIAHQLDEEERMRMAEGGVTSEDYRTFLQQPSGNMDDSGFFSIQWFNLNSLLTGPELISDTYLALFLAQLQQEVTQ

SEQ ID NO: 6912 - protein, 79 aa, Homo sapiens; identical to SEQ ID NO: 6891
  Payload ID: 1477;
  Gene Symbol: ATXN3;
  Gene Name: ataxin 3;
  ENSP ID: ENSP00000451733

SEQ ID NO: 6913 - protein, 159 aa, Homo sapiens
  Payload ID: 1477;
  Gene Symbol: ATXN3;
  Gene Name: ataxin 3;
  ENSP ID: ENSP00000451769
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEG

SEQ ID NO: 6914 - protein, 150 aa, Homo sapiens
  Payload ID: 1477;
  Gene Symbol: ATXN3;
  Gene Name: ataxin 3;
  ENSP ID: ENSP00000451771
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQVILYLSLRVICQIAKLTNSCR

SEQ ID NO: 6915 - protein, 79 aa, Homo sapiens; identical to SEQ ID NO: 6891
  Payload ID: 1477;
  Gene Symbol: ATXN3;
  Gene Name: ataxin 3;
  ENSP ID: ENSP00000451910

SEQ ID NO: 6916 - protein, 278 aa, Homo sapiens
  Payload ID: 1477;
  Gene Symbol: ATXN3;
  Gene Name: ataxin 3;
  ENSP ID: ENSP00000451996
MESIFHEKQEGSLCAQHCLNNLLQGEYFSPVELSSIAHQLDEEERMRMAEGGVTSEDYRTFLQQPSGNMDDSGFFSIQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSD

SEQ ID NO: 6917 - protein, 200 aa, Homo sapiens
  Payload ID: 1477;
  Gene Symbol: ATXN3;
  Gene Name: ataxin 3;
  ENSP ID: ENSP00000452139
MESIFHEKQEGSLCAQHCLNNLLQGEYFSPVELSSIAHQLDEEERMRMAEGGVTSEDYRTFLQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQVPETYLKI

SEQ ID NO: 6918 - protein, 161 aa, Homo sapiens
  Payload ID: 1477;
  Gene Symbol: ATXN3;
  Gene Name: ataxin 3;
  ENSP ID: ENSP00000452356
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEVTQ

SEQ ID NO: 6919 - protein, 79 aa, Homo sapiens; identical to SEQ ID NO: 6891
  Payload ID: 1477;
  Gene Symbol: ATXN3;
  Gene Name: ataxin 3;
  ENSP ID: ENSP00000452461

SEQ ID NO: 6920 - protein, 99 aa, Homo sapiens; identical to SEQ ID NO: 6894
  Payload ID: 1477;
  Gene Symbol: ATXN3;
  Gene Name: ataxin 3;
  ENSP ID: ENSP00000452532

SEQ ID NO: 6921 - protein, 199 aa, Homo sapiens
  Payload ID: 1477;
  Gene Symbol: ATXN3;
  Gene Name: ataxin 3;
  ENSP ID: ENSP00000474067
QEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQGDLPDCEADQLLQMIRVQQMHRPKLIGEELAQLKEQRVHKTDLERVLEANDGSGMLDEDEEDLQRALALSRQEIDMED

SEQ ID NO: 6922 - protein, 361 aa, Homo sapiens
  Payload ID: 1477;
  Gene Symbol: ATXN3;
  Gene Name: ataxin 3;
  Uniprot ID:  P54252;
  ENSP ID: ENSP00000478320
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 6923 - protein, 288 aa, Homo sapiens
  Payload ID: 1477;
  Gene Symbol: ATXN3;
  Gene Name: ataxin 3;
  ENSP ID: ENSP00000481390
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEESEETRSLL

SEQ ID NO: 6924 - protein, 301 aa, Homo sapiens
  Payload ID: 1477;
  Gene Symbol: ATXN3;
  Gene Name: ataxin 3;
  ENSP ID: ENSP00000481998
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFENHNSEVDEGKF

SEQ ID NO: 6925 - protein, 324 aa, Homo sapiens
  Payload ID: 1477;
  Gene Symbol: ATXN3;
  Gene Name: ataxin 3;
  ENSP ID: ENSP00000484016
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKPRQADYERQQQQKQQQQQQQQQQGPIRTEFTSM

SEQ ID NO: 6926 - protein, 355 aa, Homo sapiens
  Payload ID: 1478;
  Gene Symbol: ATXN3L;
  Gene Name: ataxin 3-like;
  Uniprot ID:  Q9H3M9;
  ENSP ID: ENSP00000369996
MDFIFHEKQEGFLCAQHCLNNLLQGEYFSPVELASIAHQLDEEERMRMAEGGVTSEEYLAFLQQPSENMDDTGFFSIQVISNALKFWGLEIIHFNNPEYQKLGIDPINERSFICNYKQHWFTIRKFGKHWFNLNSLLAGPELISDTCLANFLARLQQQAYSVFVVKGDLPDCEADQLLQIISVEEMDTPKLNGKKLVKQKEHRVYKTVLEKVSEESDESGTSDQDEEDFQRALELSRQETNREDEHLRSTIELSMQGSSGNTSQDLPKTSCVTPASEQPKKIKEDYFEKHQQEQKQQQQQSDLPGHSSYLHERPTTSSRAIESDLSDDISEGTVQAAVDTILEIMRKNLKIKGEK

SEQ ID NO: 6927 - protein, 162 aa, Homo sapiens [sequence omitted]

SEQ ID NO: 6928 - protein, 892 aa, Homo sapiens
  Payload ID: 1479;
  Gene Symbol: ATXN7;
  Gene Name: ataxin 7;
  Uniprot ID:  O15265;
  ENSP ID: ENSP00000295900
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQPKARP

SEQ ID NO: 6929 - protein, 25 aa, Homo sapiens
  Payload ID: 1479;
  Gene Symbol: ATXN7;
  Gene Name: ataxin 7;
  ENSP ID: ENSP00000418203
MSERAADDVRGEPRRAAAAAGGAAA

SEQ ID NO: 6930 - protein, 892 aa, Homo sapiens; identical to SEQ ID NO: 6928
  Payload ID: 1479;
  Gene Symbol: ATXN7;
  Gene Name: ataxin 7;
  Uniprot ID:  O15265;
  ENSP ID: ENSP00000420234

SEQ ID NO: 6931 - protein, 115 aa, Homo sapiens
  Payload ID: 1479;
  Gene Symbol: ATXN7;
  Gene Name: ataxin 7;
  ENSP ID: ENSP00000428067
DKLIGKKRKCSPSSSSINNSSSKPTKVAKVPAVNNVHMKHTGTIPGAQGLMNSSLLHQDISSPCLRTGISATSPQSPDLKSKGTSLTAENSTGRNNADTFEDKLHLHSALWTPRC

SEQ ID NO: 6932 - protein, 747 aa, Homo sapiens
  Payload ID: 1479;
  Gene Symbol: ATXN7;
  Gene Name: ataxin 7;
  Uniprot ID:  O15265;
  ENSP ID: ENSP00000428277
MEGSKTPLQSSPSAQELKAPLERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQPKARP

SEQ ID NO: 6933 - protein, 945 aa, Homo sapiens
  Payload ID: 1479;
  Gene Symbol: ATXN7;
  Gene Name: ataxin 7;
  Uniprot ID:  O15265;
  ENSP ID: ENSP00000439585
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQDISSPCLRTGISATSPQSPDLKSKGTSLTAENSTGRNNADTFEDKLHLHSALWTPRCL

SEQ ID NO: 6934 - protein, 146 aa, Homo sapiens
  Payload ID: 1480;
  Gene Symbol: ATXN7L1;
  Gene Name: ataxin 7-like 1;
  Uniprot ID:  Q9ULK2;
  ENSP ID: ENSP00000326344
MTSERSRIPCLSAAAAEGTGKKQQEGRAMATLDRKVPSPEAFLGKPWSSWIDAAKLHCSDNVDLEEAGKEGGKSREVMRLNKEDMHLFGHYPAHDDFYLVVCSACNQVVKPQVFQSHCGRKQDNRRNEGISRSGPESSQAIEKHQV

SEQ ID NO: 6935 - protein, 861 aa, Homo sapiens
  Payload ID: 1480;
  Gene Symbol: ATXN7L1;
  Gene Name: ataxin 7-like 1;
  Uniprot ID:  Q9ULK2;
  ENSP ID: ENSP00000410759
MTSERSRIPCLSAAAAEGTGKKQQEGRAMATLDRKVPSPEAFLGKPWSSWIDAAKLHCSDNVDLEEAGKEGGKSREVMRLNKEDMHLFGHYPAHDDFYLVVCSACNQVVKPQVFQSHCERRHGSMCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVGKNSSLALSQSSPSSISSPGHSRQNTNRTGRIRTLP

SEQ ID NO: 6936 - protein, 738 aa, Homo sapiens
  Payload ID: 1480;
  Gene Symbol: ATXN7L1;
  Gene Name: ataxin 7-like 1;
  Uniprot ID:  Q9ULK2;
  ENSP ID: ENSP00000418476
MCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVGKNSSLALSQSSPSSISSPGHSRQKNTNRTGRIRTLP

SEQ ID NO: 6937 - protein, 95 aa, Homo sapiens
  Payload ID: 1480;
  Gene Symbol: ATXN7L1;
  Gene Name: ataxin 7-like 1;
  ENSP ID: ENSP00000418679
MATLDRKVPSPEAFLGKPWSSWIDAAKLHCSDNMHLFGHYPAHDDFYLVVCSACNQVVKPQVFQSHCGRKQDNRRNEGISRSGPESSQAIEKHQV

SEQ ID NO: 6938 - protein, 574 aa, Homo sapiens
  Payload ID: 1480;
  Gene Symbol: ATXN7L1;
  Gene Name: ataxin 7-like 1;
  ENSP ID: ENSP00000418900
PSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKHRNPSHRASGPSPLFRTCLTNLLSLSNIGAAWVSTLESVAPRYPLNLAAQTPGPGGPEPGGMAADGGVEDIRKKRNGQDSFFFNKHLTLHQEPPTQYSLSARKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVRDLLAPPSPALGGRGSWAAPLLSRAAPTGNTSLIPVLVFPEGSFHPLL

SEQ ID NO: 6939 - protein, 743 aa, Homo sapiens
  Payload ID: 1480;
  Gene Symbol: ATXN7L1;
  Gene Name: ataxin 7-like 1;
  ENSP ID: ENSP00000419566
MCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPEKILNGKGILPTTIDKKHQNGTKNSNKPYRRLSEREFDPNKHCGVLDPETKKPCTRSLTCKTHSLSHRRAVPGRKKQFDLLLAEHKAKSREKEVKDKEHLLTSTREILPSQSGPAQDSLLGSSGSSGPEPKVASPAKSRPPNSVLPRPSSANSISSSTSSNHSGHTPEPPLPPVGGDLASRLSSDEGEMDGADESEKLDCQFSTHHPRPLAFCSFGSRLMGRGYYVFDRRWDRFRFALNSMVEKHLNSQMWKKIPPAADSPLPSPAAHITTPVPASVLQPFSNPSAVYLPSAPISSRLTSSYIMTSAMLSNAAFVTSPDPSALMSHTTAFPHVAATLSIMDSTFKAPSAVSPIPAVIPSPSHKPSKTKTSKSSKVKDLSTRSDESPSNKKRKPQSSTSSSSSSSSSSLQTSLSSPLSGPHKKNCVLNASSALNSYQAAPPYNSLSVHNSNNGVSPLSAKLEPSGRTSLPGGPADIVRQVGAVGGSSDSCPLSVPSLALHAGDLSLASHNAVSSLPLSFDKSEGKKRKNSSSSSKACKITKMPGMNSVHKKNPPSLLAPVPDPVNSTSSRQVRDLLAPPSPALGGRGSWAAPLLSRAAPTGNTSLIPVLVFPEG

SEQ ID NO: 6940 - protein, 68 aa, Homo sapiens
  Payload ID: 1480;
  Gene Symbol: ATXN7L1;
  Gene Name: ataxin 7-like 1;
  ENSP ID: ENSP00000420483
MCRPSPSPVSPASNPRTSLVQVKTKACLSGHHSASSTSKPFKTPKDNLLTSSSKQHTVFPAKGSRDKP

SEQ ID NO: 6941 - protein, 722 aa, Homo sapiens
  Payload ID: 1481;
  Gene Symbol: ATXN7L2;
  Gene Name: ataxin 7-like 2;
  Uniprot ID:  Q5T6C5;
  ENSP ID: ENSP00000358886
MAVRERAAAAMAALERRVPSLDDFAGQSWSSWVERADLPAADGAELEESSKNTKKLDAMTLIKEDMSIFGHCPAHDDFYLVVCNHCSQVVKPQAFQKHCERRHGPLSKLYGRAPPPPPAPASSQKCHVVNGQGPACRAPGSTKTSSREKGQGSRSRGHQPPEKTQKDNLCQPGGLTKDSPGKPPMAPPSKEPPGRENIEIIPSEGSSHWAEGSPPEKEPSGTRLPPKTHRKMARKECDLNRQCGVINPETKKICTRLLTCKIHSVHQRREVQGRAKDFDVLVAELKANSRKGESPKEKSPGRKEQVLERPSQELPSSVQVVAAVAAPSSTFSVRAKQTYPYCALPRSRASSESELDDEGPCGGDGDPGLFPFPMPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACPASMPPTKDNLVPSYPAGSPSVAAACSQAECMGGSQAITSPLPANTPSPSFSKLPPSKASKSSKGKDGVEVEAPSRKRKLSPGPTTLKRTCILEPTGKGKPSGCRGLSAKTKTALSMGLNGTMGPRVKRAGPLDCRGSPHQLPTPVKASQLENRGAAGHPAKALPTNCLSEEEVAKKRKNLATYCRPVKAKHCQAGAPADVACSVRRKKPGPALAFEEKCSTLKSKAH

SEQ ID NO: 6942 - protein, 103 aa, Homo sapiens
  Payload ID: 1481;
  Gene Symbol: ATXN7L2;
  Gene Name: ataxin 7-like 2;
  ENSP ID: ENSP00000474312
MAVRERAAAAMAALERRVPSLDDFAGQSWSSWVERADLPAADETEVQGQPLPKGPLRRGGTCIADQGDFEDAQGPKTAVSLLCDHPISAGPEKLGVTLTMLWG

SEQ ID NO: 6943 - protein, 580 aa, Homo sapiens
  Payload ID: 1481;
  Gene Symbol: ATXN7L2;
  Gene Name: ataxin 7-like 2;
  ENSP ID: ENSP00000484134
MAVRERAAAAMAALERRVPSLDDFAGQSWSSWVERADLPAADGAELEESSKNTKKLDAMTLIKEDMSIFGHCPAHDDFYLVVCNHCSQVVKPQAFQKHCERRHGPLSKLYGRAPPPPPAPASSQKCHVVNGQGPACRAPGSTKTSSREKGQGSRSRGHQPPEKTQKDNLCQPGGLTKDSPGKPPMAPPSKEPPGRENIEIIPSEGSSHWAEGSPPEKEPSGTRLPPKTHRKMARKECDLNRQCGVINPETKKICTRLLTCKIHSVHQRREVQGRAKDFDVLVAELKANSRKGESPKEKSPGRKEQVLERPSQELPSSVQVVAAVAAPSSTFSVRAKQTYPYCALPRSRASSESELDDEGPCGGDGDPGLFPFPMPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACPASMPPTKDNLVPSYPAGSPSVAAACSQAECMGEPGYHLTTACQHAIPVLQQAAAFQGQQVIQRQGRGGGGGPFSKAEVIPWPYHS

SEQ ID NO: 6944 - protein, 347 aa, Homo sapiens
  Payload ID: 1482;
  Gene Symbol: ATXN7L3;
  Gene Name: ataxin 7-like 3;
  Uniprot ID:  Q14CW9;
  ENSP ID: ENSP00000374035
MKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 6945 - protein, 354 aa, Homo sapiens
  Payload ID: 1482;
  Gene Symbol: ATXN7L3;
  Gene Name: ataxin 7-like 3;
  Uniprot ID:  Q14CW9;
  ENSP ID: ENSP00000397259
MKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKLWYLPFQNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 6946 - protein, 72 aa, Homo sapiens
  Payload ID: 1482;
  Gene Symbol: ATXN7L3;
  Gene Name: ataxin 7-like 3;
  ENSP ID: ENSP00000465210
MCTRSLRCPQHTDEQRRTVRIYFLGPSAVLPEVESSLDNDSFDMTDSQALISRLQWDGSSDLSPSDSGSSKT

SEQ ID NO: 6947 - protein, 308 aa, Homo sapiens
  Payload ID: 1482;
  Gene Symbol: ATXN7L3;
  Gene Name: ataxin 7-like 3;
  ENSP ID: ENSP00000465614
MKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKT

SEQ ID NO: 6948 - protein, 139 aa, Homo sapiens
  Payload ID: 1482;
  Gene Symbol: ATXN7L3;
  Gene Name: ataxin 7-like 3;
  ENSP ID: ENSP00000466717
MKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDI

SEQ ID NO: 6949 - protein, 186 aa, Homo sapiens
  Payload ID: 1482;
  Gene Symbol: ATXN7L3;
  Gene Name: ataxin 7-like 3;
  ENSP ID: ENSP00000467092
  MOD_RES (1)..(1): Any amino acid
XSLKHKNGELSNSDPFKYNNSTGISYETLGPEELRSLLTTLIFLFQQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 6950 - protein, 147 aa, Homo sapiens
  Payload ID: 1482;
  Gene Symbol: ATXN7L3;
  Gene Name: ataxin 7-like 3;
  ENSP ID: ENSP00000467153
MKMEEMSLSGLDNSKLEAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYG

SEQ ID NO: 6951 - protein, 97 aa, Homo sapiens
  Payload ID: 1483;
  Gene Symbol: ATXN7L3B;
  Gene Name: ataxin 7-like 3B;
  Uniprot ID:  Q96GX2;
  ENSP ID: ENSP00000430000
MEEISLANLDTNKLEAIAQEIYVDLIEDSCLGFCFEVHRAVKCGYFYLEFAETGSVKDFGIQPVEDKGACRLPLCSLPGEPGNGPDQQLQRSPPEFQ

SEQ ID NO: 6952 - protein, 193 aa, Homo sapiens
  Payload ID: 1484;
  Gene Symbol: ATHL1;
  Gene Name: ATH1, acid trehalase-like 1 (yeast);
  ENSP ID: ENSP00000380780
  MOD_RES (1)..(1): Any amino acid
XEIYEAVTSPQGPAMTWSMFAVGWMELKDAVRARGLLDRSFANMAEPFKVWTENADGSGAVNFLTGMGGFLQAVVFGCTGFRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTV

SEQ ID NO: 6953 - protein, 489 aa, Homo sapiens
  Payload ID: 1484;
  Gene Symbol: ATHL1;
  Gene Name: ATH1, acid trehalase-like 1 (yeast);
  ENSP ID: ENSP00000386297
MLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 6954 - protein, 764 aa, Homo sapiens
  Payload ID: 1484;
  Gene Symbol: ATHL1;
  Gene Name: ATH1, acid trehalase-like 1 (yeast);
  ENSP ID: ENSP00000387099
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKHLTCASPTLTTGVEGRPLRLCTEHHLGLVCPGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 6955 - protein, 737 aa, Homo sapiens
  Payload ID: 1484;
  Gene Symbol: ATHL1;
  Gene Name: ATH1, acid trehalase-like 1 (yeast);
  Uniprot ID:  Q32M88;
  ENSP ID: ENSP00000387185
MEDAGEDPTTFAAHSLPSDPRLLATVTNAYLGTRVFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEGEEARTWDFLTAVGGSQAEAQACLTEALQLQARGALYTAHAQAWAQLWVECGLDVVGPLQLRQALRGSLYYLLSALPQPKAPGYICHGLSPGGLSNGSREECYWGHVFWDQDLWMFPSILMFHPEAARAILEYRIRTLDGALENAQNLGYQGAKFAWESADSGLEVCPEDIYGVQEVHVNGAVVLAFELYYHTTQDLQLFREAGGWDVVRAVAEFWCSRVEWSPREEKYHLRGVMSPDEYHSGVNNSVYTNVLVQNSLRFAAALAQDLGLPIPSQWLAVADKIKVPFDVEQNFHPEFDGYEPGEVVKQADVVLLGYPVPFSLSPDVRRKNLEIYEAVTSPQGPAMTWSMFAVGWMELKDAVRARGLLDRSFANMAEPFKVWTENADGSGAVNFLTGMGGFLQAVVFGCTGFRVTRAGVTFDPVCLSGISRVSVSGIFYQGNKLNFSFSEDSVTVEVTARAGPWAPHLEAELWPSQSRLSLLPGHKVSFPRSAGRIQMSPPKLPGSSSSEFPGRTFSDVRDPLQSPLWVTLGSSSPTESLTVDPASE

SEQ ID NO: 6956 - protein, 203 aa, Homo sapiens
  Payload ID: 1484;
  Gene Symbol: ATHL1;
  Gene Name: ATH1, acid trehalase-like 1 (yeast);
  ENSP ID: ENSP00000431881
  MOD_RES (1)..(1): Any amino acid
XFHDTLHVSGVYNGAGGDTHRAMLPSPLNVRLEAPAGMGEQLTETFALDTNTGSFLHTLEGPRFRASQCIYAHRTLPHVLAFRVSIARLAPGSGPITLLLRSAFSPESPDLDLHQGPDFQGARYLYGHTLTPEQPGGPQQEVHMLWTPAPPDLTLGEVPCPSPRPQDTSAMASVLGASPMGAVRNATGATSSGTRTSGCSRVS

SEQ ID NO: 6957 - protein, 899 aa, Homo sapiens
  Payload ID: 1485;
  Gene Symbol: AKNA;
  Gene Name: AT-hook transcription factor;
  Uniprot ID:  Q7Z591;
  ENSP ID: ENSP00000223791
MPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 6958 - protein, 1439 aa, Homo sapiens
  Payload ID: 1485;
  Gene Symbol: AKNA;
  Gene Name: AT-hook transcription factor;
  Uniprot ID:  Q7Z591;
  ENSP ID: ENSP00000303769
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 6959 - protein, 831 aa, Homo sapiens
  Payload ID: 1485;
  Gene Symbol: AKNA;
  Gene Name: AT-hook transcription factor;
  Uniprot ID:  Q7Z591;
  ENSP ID: ENSP00000309222
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLE

SEQ ID NO: 6960 - protein, 1358 aa, Homo sapiens
  Payload ID: 1485;
  Gene Symbol: AKNA;
  Gene Name: AT-hook transcription factor;
  Uniprot ID:  Q7Z591;
  ENSP ID: ENSP00000363188
MLRSEWPVFPEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 6961 - protein, 384 aa, Homo sapiens
  Payload ID: 1485;
  Gene Symbol: AKNA;
  Gene Name: AT-hook transcription factor;
  Uniprot ID:  Q7Z591;
  ENSP ID: ENSP00000363192
MSAGGGTRGYSPRSPGATSQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 6962 - protein, 1439 aa, Homo sapiens; identical to SEQ ID NO: 6958
  Payload ID: 1485;
  Gene Symbol: AKNA;
  Gene Name: AT-hook transcription factor;
  Uniprot ID:  Q7Z591;
  ENSP ID: ENSP00000363201

SEQ ID NO: 6963 - protein, 558 aa, Homo sapiens
  Payload ID: 1486;
  Gene Symbol: ATL1;
  Gene Name: atlastin GTPase 1;
  Uniprot ID:  Q8WXF7;
  ENSP ID: ENSP00000351155
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWVGDYNEPLTGFSWRGGSERETTGIQIWSEIFLINKPDGKKVAVLLMDTQGTFDSQSTLRDSATVFALSTMISSIQVYNLSQNVQEDDLQHLQLFTEYGRLAMEETFLKPFQSLIFLVRDWSFPYEFSYGADGGAKFLEKRLKVSGNQHEELQNVRKHIHSCFTNISCFLLPHPGLKVATNPNFDGKLKEIDDEFIKNLKILIPWLLSPESLDIKEINGNKITCRGLVEYFKAYIKIYQGEELPHPKSMLQATAEANNLAAVATAKDTYNKKMEEICGGDKPFLAPNDLQTKHLQLKEESVKLFRGVKKMGGEEFSRRYLQQLESEIDELYIQYIKHNDSKNIFHAARTPATLFVVIFITYVIAGVTGFIGLDIIASLCNMIMGLTLITLCTWAYIRYSGEYRELGAVIDQVAAALWDQGSTNEALYKLYSAAATHRHLYHQAFPTPKSESTEQSEKKKM

SEQ ID NO: 6964 - protein, 553 aa, Homo sapiens
  Payload ID: 1486;
  Gene Symbol: ATL1;
  Gene Name: atlastin GTPase 1;
  Uniprot ID:  Q8WXF7;
  ENSP ID: ENSP00000413675
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWVGDYNEPLTGFSWRGGSERETTGIQIWSEIFLINKPDGKKVAVLLMDTQGTFDSQSTLRDSATVFALSTMISSIQVYNLSQNVQEDDLQHLQLFTEYGRLAMEETFLKPFQSLIFLVRDWSFPYEFSYGADGGAKFLEKRLKVSGNQHEELQNVRKHIHSCFTNISCFLLPHPGLKVATNPNFDGKLKEIDDEFIKNLKILIPWLLSPESLDIKEINGNKITCRGLVEYFKAYIKIYQGEELPHPKSMLQATAEANNLAAVATAKDTYNKKMEEICGGDKPFLAPNDLQTKHLQLKEESVKLFRGVKKMGGEEFSRRYLQQLESEIDELYIQYIKHNDSKNIFHAARTPATLFVVIFITYVIAGVTGFIGLDIIASLCNMIMGLTLITLCTWAYIRYSGEYRELGAVIDQVAAALWDQALYKLYSAAATHRHLYHQAFPTPKSESTEQSEKKKM

SEQ ID NO: 6965 - protein, 52 aa, Homo sapiens
  Payload ID: 1486;
  Gene Symbol: ATL1;
  Gene Name: atlastin GTPase 1;
  ENSP ID: ENSP00000450897
GNQHEELQNVRKHIHSCFTNISCFLLPHPGLKVATNPNFDGKLKGLYKDLSR

SEQ ID NO: 6966 - protein, 29 aa, Homo sapiens
  Payload ID: 1486;
  Gene Symbol: ATL1;
  Gene Name: atlastin GTPase 1;
  ENSP ID: ENSP00000450989
MAKNRRDRNSWGGFSEKTYEWSSEEEEPV

SEQ ID NO: 6967 - protein, 47 aa, Homo sapiens
  Payload ID: 1486;
  Gene Symbol: ATL1;
  Gene Name: atlastin GTPase 1;
  ENSP ID: ENSP00000451015
MDFMLRYMYNQESVDWVGDYNEPLTGFSWRGGSERETTGIQIWSEIF

SEQ ID NO: 6968 - protein, 105 aa, Homo sapiens
  Payload ID: 1486;
  Gene Symbol: ATL1;
  Gene Name: atlastin GTPase 1;
  ENSP ID: ENSP00000451100
QQLESEIDELYIQYIKHNDSKNIFHAARTPATLFVVIFITYVIAGVTGFIGLDIIASLCNMIMGLTLITLCTWAYIRYSGEYRELGAVIDQVAAALWDQGSTNEI

SEQ ID NO: 6969 - protein, 75 aa, Homo sapiens
  Payload ID: 1486;
  Gene Symbol: ATL1;
  Gene Name: atlastin GTPase 1;
  ENSP ID: ENSP00000452074
MDTQGTFDSQSTLRDSATVFALSTMISSIQVYNLSQNVQEDDLQHLQLFTEYGRLAMEETFLKPFQSLIFLVRDW

SEQ ID NO: 6970 - protein, 99 aa, Homo sapiens
  Payload ID: 1486;
  Gene Symbol: ATL1;
  Gene Name: atlastin GTPase 1;
  ENSP ID: ENSP00000452506
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDW

SEQ ID NO: 6971 - protein, 583 aa, Homo sapiens
  Payload ID: 1487;
  Gene Symbol: ATL2;
  Gene Name: atlastin GTPase 2;
  Uniprot ID:  Q8NHH9;
  ENSP ID: ENSP00000368237
MAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 6972 - protein, 49 aa, Homo sapiens
  Payload ID: 1487;
  Gene Symbol: ATL2;
  Gene Name: atlastin GTPase 2;
  ENSP ID: ENSP00000383944
MAEGDEAARGQQPHQGLWRRRRTSDPSAAVNHVSSTTSLGFSKLDWWKQ

SEQ ID NO: 6973 - protein, 412 aa, Homo sapiens
  Payload ID: 1487;
  Gene Symbol: ATL2;
  Gene Name: atlastin GTPase 2;
  Uniprot ID:  Q8NHH9;
  ENSP ID: ENSP00000384062
MDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 6974 - protein, 413 aa, Homo sapiens
  Payload ID: 1487;
  Gene Symbol: ATL2;
  Gene Name: atlastin GTPase 2;
  ENSP ID: ENSP00000385446
MDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQRSPRKVFSKLFEVTRRRMVHRALSSAQRQRLSSNNNKKKN

SEQ ID NO: 6975 - protein, 565 aa, Homo sapiens
  Payload ID: 1487;
  Gene Symbol: ATL2;
  Gene Name: atlastin GTPase 2;
  Uniprot ID:  Q8NHH9;
  ENSP ID: ENSP00000390743
MVLKKGIKFFQRLINSKSLRFGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 6976 - protein, 185 aa, Homo sapiens
  Payload ID: 1487;
  Gene Symbol: ATL2;
  Gene Name: atlastin GTPase 2;
  ENSP ID: ENSP00000404921
MAEGDEAARGQQPHQGLWRRRRTSDPSAAVNHVSSTTSLESCSVARLECSGTIFAYCNLPGSSDSSASASQVAGITGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETT

SEQ ID NO: 6977 - protein, 93 aa, Homo sapiens
  Payload ID: 1487;
  Gene Symbol: ATL2;
  Gene Name: atlastin GTPase 2;
  ENSP ID: ENSP00000406004
MAEGDEAARGQQPHQGLWRRRRTSDPSAAVNHVSSTTSLDGVSLCRPGWGAVARSRLTASSASWVHAILRPQPPEYLGLQAPATVSGLLFLYF

SEQ ID NO: 6978 - protein, 175 aa, Homo sapiens
  Payload ID: 1487;
  Gene Symbol: ATL2;
  Gene Name: atlastin GTPase 2;
  ENSP ID: ENSP00000409811
MAEGDEAARGQQPHQGLWRRRRTSDPSAAVNHVSSTTSLEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFK

SEQ ID NO: 6979 - protein, 258 aa, Homo sapiens
  Payload ID: 1487;
  Gene Symbol: ATL2;
  Gene Name: atlastin GTPase 2;
  ENSP ID: ENSP00000410592
  MOD_RES (1)..(1): Any amino acid
XEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVE

SEQ ID NO: 6980 - protein, 86 aa, Homo sapiens
  Payload ID: 1487;
  Gene Symbol: ATL2;
  Gene Name: atlastin GTPase 2;
  ENSP ID: ENSP00000413216
MAEGDEAARGQQPHQGLWRRRRTSDPSAAVNHVSSTTSLESCSVARLECSGTIFAYCNLPGSSDSSASASQVAGITGFSKLDWWKQ

SEQ ID NO: 6981 - protein, 579 aa, Homo sapiens
  Payload ID: 1487;
  Gene Symbol: ATL2;
  Gene Name: atlastin GTPase 2;
  Uniprot ID:  Q8NHH9;
  ENSP ID: ENSP00000415336
MAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVFSKLFEVTRRRMVHRALSSAQRQRLSSNNNKKKN

SEQ ID NO: 6982 - protein, 413 aa, Homo sapiens; identical to SEQ ID NO: 6974
  Payload ID: 1487;
  Gene Symbol: ATL2;
  Gene Name: atlastin GTPase 2;
  ENSP ID: ENSP00000486809

SEQ ID NO: 6983 - protein, 541 aa, Homo sapiens
  Payload ID: 1488;
  Gene Symbol: ATL3;
  Gene Name: atlastin GTPase 3;
  Uniprot ID:  Q6DD88;
  ENSP ID: ENSP00000381844
MLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 6984 - protein, 523 aa, Homo sapiens
  Payload ID: 1488;
  Gene Symbol: ATL3;
  Gene Name: atlastin GTPase 3;
  ENSP ID: ENSP00000437593
MESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 6985 - protein, 169 aa, Homo sapiens
  Payload ID: 1488;
  Gene Symbol: ATL3;
  Gene Name: atlastin GTPase 3;
  ENSP ID: ENSP00000441842
MRTAGRDPVSAGLQFPKDGSTQRPANRARFVPARTRPSPLHPCCFCFEGGGSMLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETT

SEQ ID NO: 6986 - protein, 823 aa, Homo sapiens
  Payload ID: 1489;
  Gene Symbol: ATMIN;
  Gene Name: ATM interactor;
  Uniprot ID:  O43313;
  ENSP ID: ENSP00000299575
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQHFMKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 6987 - protein, 667 aa, Homo sapiens
  Payload ID: 1489;
  Gene Symbol: ATMIN;
  Gene Name: ATM interactor;
  Uniprot ID:  O43313;
  ENSP ID: ENSP00000455497
MKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 6988 - protein, 667 aa, Homo sapiens; identical to SEQ ID NO: 6987
  Payload ID: 1489;
  Gene Symbol: ATMIN;
  Gene Name: ATM interactor;
  Uniprot ID:  O43313;
  ENSP ID: ENSP00000463478

SEQ ID NO: 6989 - protein, 54 aa, Homo sapiens
  Payload ID: 1489;
  Gene Symbol: ATMIN;
  Gene Name: ATM interactor;
  ENSP ID: ENSP00000464427
MKMHAEKKHKCSKCSNSYGTEWDLKRHAEDCGKTFRCTCGCPYASRTALQSHIY

SEQ ID NO: 6990 - protein, 3056 aa, Homo sapiens
  Payload ID: 1490;
  Gene Symbol: ATM;
  Gene Name: ATM serine/threonine kinase;
  Uniprot ID:  Q13315;
  ENSP ID: ENSP00000278616
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 6991 - protein, 3056 aa, Homo sapiens; identical to SEQ ID NO: 6990
  Payload ID: 1490;
  Gene Symbol: ATM;
  Gene Name: ATM serine/threonine kinase;
  Uniprot ID:  Q13315;
  ENSP ID: ENSP00000388058

SEQ ID NO: 6992 - protein, 93 aa, Homo sapiens
  Payload ID: 1490;
  Gene Symbol: ATM;
  Gene Name: ATM serine/threonine kinase;
  ENSP ID: ENSP00000432318
MSLVLNDLLICCRQLEHDRATERKKEVEKFKRLIRDPETIKHLDRHSDSKQGKYLNWDAVFRFLQKYIQKETECLRIAKPNVSASTQASRQKK

SEQ ID NO: 6993 - protein, 154 aa, Homo sapiens
  Payload ID: 1490;
  Gene Symbol: ATM;
  Gene Name: ATM serine/threonine kinase;
  ENSP ID: ENSP00000433955
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRKLFSVYFRLYLKPSQDVHRVLVARIIHAVTKGCCSQTDGLNSKF

SEQ ID NO: 6994 - protein, 155 aa, Homo sapiens
  Payload ID: 1490;
  Gene Symbol: ATM;
  Gene Name: ATM serine/threonine kinase;
  ENSP ID: ENSP00000434327
IDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRKLTIFSQ

SEQ ID NO: 6995 - protein, 77 aa, Homo sapiens
  Payload ID: 1490;
  Gene Symbol: ATM;
  Gene Name: ATM serine/threonine kinase;
  ENSP ID: ENSP00000435524
  MOD_RES (1)..(1): Any amino acid
XCEVKTDFCQTVLPYLIHDILLQDTNESWRNLLSTHVQGFFTSCLRHFSQTSRSTTPANLDSDLLQEQFLMMLSGWI

SEQ ID NO: 6996 - protein, 1369 aa, Homo sapiens
  Payload ID: 1490;
  Gene Symbol: ATM;
  Gene Name: ATM serine/threonine kinase;
  ENSP ID: ENSP00000435747
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFS

SEQ ID NO: 6997 - protein, 135 aa, Homo sapiens
  Payload ID: 1490;
  Gene Symbol: ATM;
  Gene Name: ATM serine/threonine kinase;
  ENSP ID: ENSP00000469471
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGA

SEQ ID NO: 6998 - protein, 112 aa, Homo sapiens
  Payload ID: 1490;
  Gene Symbol: ATM;
  Gene Name: ATM serine/threonine kinase;
  ENSP ID: ENSP00000480205
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRSK

SEQ ID NO: 6999 - protein, 168 aa, Homo sapiens
  Payload ID: 1490;
  Gene Symbol: ATM;
  Gene Name: ATM serine/threonine kinase;
  ENSP ID: ENSP00000483338
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLGMF

SEQ ID NO: 7000 - protein, 354 aa, Homo sapiens
  Payload ID: 1491;
  Gene Symbol: ATOH1;
  Gene Name: atonal bHLH transcription factor 1;
  Uniprot ID:  Q92858;
  ENSP ID: ENSP00000302216
MSRLLHAEEWAEVKELGDHHRQPQPHHLPQPPPPPQPPATLQAREHPVYPPELSLLDSTDPRAWLAPTLQGICTARAAQYLLHSPELGASEAAAPRDEVDGRGELVRRSSGGASSSKSPGPVKVREQLCKLKGGVVVDELGCSRQRAPSSKQVNGVQKQRRLAANARERRRMHGLNHAFDQLRNVIPSFNNDKKLSKYETLQMAQIYINALSELLQTPSGGEQPPPPPASCKSDHHHLRTAASYEGGAGNATAAGAQQASGGSQRPTPPGSCRTRFSAPASAGGYSVQLDALHFSTFEDSALTAMMAQKNLSPSLPGSILQPVQEENSKTSPRSHRSDGEFSPHSHYSDSDEAS

SEQ ID NO: 7001 - protein, 152 aa, Homo sapiens
  Payload ID: 1492;
  Gene Symbol: ATOH7;
  Gene Name: atonal bHLH transcription factor 7;
  Uniprot ID:  Q8N100;
  ENSP ID: ENSP00000362777
MKSCKPSGPPAGARVAPPCAGGTECAGTCAGAGRLESAARRRLAANARERRRMQGLNTAFDRLRRVVPQWGQDKKLSKYETLQMALSYIMALTRILAEAERFGSERDWVGLHCEHFGRDHYLPFPGAKLPGESELYSQRLFGFQPEPFQMAT

SEQ ID NO: 7002 - protein, 321 aa, Homo sapiens
  Payload ID: 1493;
  Gene Symbol: ATOH8;
  Gene Name: atonal bHLH transcription factor 8;
  Uniprot ID:  Q96SQ7;
  ENSP ID: ENSP00000304676
MKHIPVLEDGPWKTVCVKELNGLKKLKRKGKEPARRANGYKTFRLDLEAPEPRAVATNGLRDRTHRLQPVPVPVPVPVPVAPAVPPRGGTDTAGERGGSRAPEVSDARKRCFALGAVGPGLPTPPPPPPPAPQSQAPGGPEAQPFREPGLRPRILLCAPPARPAPSAPPAPPAPPESTVRPAPPTRPGESSYSSISHVIYNNHQDSSASPRKRPGEATAASSEIKALQQTRRLLANARERTRVHTISAAFEALRKQVPCYSYGQKLSKLAILRIACNYILSLARLADLDYSADHSNLSFSECVQRCTRTLQAEGRAKKRKE

SEQ ID NO: 7003 - protein, 1101 aa, Homo sapiens
  Payload ID: 1494;
  Gene Symbol: ACLY;
  Gene Name: ATP citrate lyase;
  Uniprot ID:  P53396;
  ENSP ID: ENSP00000253792
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQDSVPSPRSLQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 7004 - protein, 1091 aa, Homo sapiens
  Payload ID: 1494;
  Gene Symbol: ACLY;
  Gene Name: ATP citrate lyase;
  Uniprot ID:  P53396;
  ENSP ID: ENSP00000345398
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEPFVPHSQAEEFYVCIYATREGDYVLFHHEGGVDVGDVDAKAQKLLVGVDEKLNPEDIKKHLLVHAPEDKKEILASFISGLFNFYEDLYFTYLEINPLVVTKDGVYVLDLAAKVDATADYICKVKWGDIEFPPPFGREAYPEEAYIADLDAKSGASLKLTLLNPKGRIWTMVAGGGASVVYSDTICDLGGVNELANYGEYSGAPSEQQTYDYAKTILSLMTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 7005 - protein, 1091 aa, Homo sapiens; identical to SEQ ID NO: 7004
  Payload ID: 1494;
  Gene Symbol: ACLY;
  Gene Name: ATP citrate lyase;
  Uniprot ID:  P53396;
  ENSP ID: ENSP00000377474

SEQ ID NO: 7006 - protein, 830 aa, Homo sapiens
  Payload ID: 1494;
  Gene Symbol: ACLY;
  Gene Name: ATP citrate lyase;
  Uniprot ID:  P53396;
  ENSP ID: ENSP00000445349
MSAKAISEQTGKELLYKFICTTSAIQNRFKYARVTPDTDWARLLQDHPWLLSQNLVVKPDQLIKRRGKLGLVGVNLTLDGVKSWLKPRLGQEATGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSESRADEVAPAKKAKPAMPQGKSTTLFSRHTKAIVWGMQTRAVQGMLDFDYVCSRDEPSVAAMVYPFTGDHKQKFYWGHKEILIPVFKNMADAMRKHPEVDVLINFASLRSAYDSTMETMNYAQIRTIAIIAEGIPEALTRKLIKKADQKGVTIIGPATVGGIKPGCFKIGNTGGMLDNILASKLYRPGSVAYVSRSGGMSNELNNIISRTTDGVYEGVAIGGDRYPGSTFMDHVLRYQDTPGVKMIVVLGEIGGTEEYKICRGIKEGRLTKPIVCWCIGTCATMFSSEVQFGHAGACANQASETAVAKNQALKEAGVFVPRSFDELGEIIQSVYEDLVANGVIVPAQEVPPPTVPMDYSWARELGLIRKPASFMTSICDERGQELIYAGMPITEVFKEEMGIGGVLGLLWFQKRLPKYSCQFIEMCLMVTADHGPAVSGAHNTIICARAGKDLVSSLTSGLLTIGDRFGGALDAAAKMFSKAFDSGIIPMEFVNKMKKEGKLIMGIGHRVKSINNPDMRVQILKDYVRQHFPATPLLDYALEVEKITTSKKPNLILNVDGLIGVAFVDMLRNCGSFTREEADEYIDIGALNGIFVLGRSMGFIGHYLDQKRLKQGLYRHPWDDISYVLPEHMSM

SEQ ID NO: 7007 - protein, 133 aa, Homo sapiens
  Payload ID: 1494;
  Gene Symbol: ACLY;
  Gene Name: ATP citrate lyase;
  ENSP ID: ENSP00000464717
MTREKHPDGKILIIGGSIANFTNVAATFKGIVRAIRDYQGPLKEHEVTIFVRRGGPNYQEGLRVMGEVGKTTGIPIHVFGTETHMTAIVGMALGHRPIPNQPPTAAHTANFLLNASGSTSTPAPSRTASFSES

SEQ ID NO: 7008 - protein, 1101 aa, Homo sapiens; identical to SEQ ID NO: 7003
  Payload ID: 1494;
  Gene Symbol: ACLY;
  Gene Name: ATP citrate lyase;
  Uniprot ID:  P53396;
  ENSP ID: ENSP00000466259

SEQ ID NO: 7009 - protein, 109 aa, Homo sapiens
  Payload ID: 1494;
  Gene Symbol: ACLY;
  Gene Name: ATP citrate lyase;
  ENSP ID: ENSP00000468705
MSAKAISEQTGKELLYKFICTTSAIQNRFKYARVTPDTDWARLLQDHPWLLSQNLVVKPDQLIKRRGKLGLVGVNLTLDGVKSWLKPRLGQEATVGKATGFLKNFLIEP

SEQ ID NO: 7010 - protein, 283 aa, Homo sapiens
  Payload ID: 1495;
  Gene Symbol: ATPAF1;
  Gene Name: ATP synthase mitochondrial F1 complex assembly  factor 1;
  ENSP ID: ENSP00000330685
MERARGPRAEADAPEEEEEAGAAMAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTNVAEAQCIANQVQLFYATDRKETYGLVETFNLRPNEFKYMSVIAELEQSGLGAELKCAQNQNKT

SEQ ID NO: 7011 - protein, 351 aa, Homo sapiens
  Payload ID: 1495;
  Gene Symbol: ATPAF1;
  Gene Name: ATP synthase mitochondrial F1 complex assembly  factor 1;
  ENSP ID: ENSP00000361005
MERARGPRAEADAPEEEEEAGAAMAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 7012 - protein, 113 aa, Homo sapiens
  Payload ID: 1495;
  Gene Symbol: ATPAF1;
  Gene Name: ATP synthase mitochondrial F1 complex assembly  factor 1;
  ENSP ID: ENSP00000431258
FLCALPRREGYEFFVGQWTGTELHFTALINIQTRGEAAASQLILYHYPELKEEKGIVLMTAEMDSTFLNVAEAQCIANQVQLFYATDRKETYGWAQLLAIHSTLIHLHQRVRK

SEQ ID NO: 7013 - protein, 183 aa, Homo sapiens
  Payload ID: 1495;
  Gene Symbol: ATPAF1;
  Gene Name: ATP synthase mitochondrial F1 complex assembly  factor 1;
  ENSP ID: ENSP00000432771
  MOD_RES (1)..(1): Any amino acid
XGKQSVNRGFTKDKTLSSIFNIEMVKEKTAEEIKQAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 7014 - protein, 86 aa, Homo sapiens
  Payload ID: 1495;
  Gene Symbol: ATPAF1;
  Gene Name: ATP synthase mitochondrial F1 complex assembly  factor 1;
  ENSP ID: ENSP00000433437
  MOD_RES (1)..(1): Any amino acid
XVRPGSGRPEGGADSSGVGAEAELQANPFYDRYRDKIQLLRRSDPAAFESRLEKRSEFRKQPVGHSRQGDFIKCVEQKDGAQNKLV

SEQ ID NO: 7015 - protein, 240 aa, Homo sapiens
  Payload ID: 1495;
  Gene Symbol: ATPAF1;
  Gene Name: ATP synthase mitochondrial F1 complex assembly  factor 1;
  Uniprot ID:  Q5TC12;
  ENSP ID: ENSP00000435732
MSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 7016 - protein, 45 aa, Homo sapiens
  Payload ID: 1495;
  Gene Symbol: ATPAF1;
  Gene Name: ATP synthase mitochondrial F1 complex assembly  factor 1;
  ENSP ID: ENSP00000436267
MSDPAAFESRLEKRSEFRKQPVGHSRQGDFIKCVEQKDGAQNKLV

SEQ ID NO: 7017 - protein, 174 aa, Homo sapiens
  Payload ID: 1495;
  Gene Symbol: ATPAF1;
  Gene Name: ATP synthase mitochondrial F1 complex assembly  factor 1;
  ENSP ID: ENSP00000436690
LIRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTNVAEAQCIANQVQLFYATDRKETYGLVETFNLRPNEFKYMSVIAELEQSGLGAELKCAQNQNKT

SEQ ID NO: 7018 - protein, 177 aa, Homo sapiens
  Payload ID: 1495;
  Gene Symbol: ATPAF1;
  Gene Name: ATP synthase mitochondrial F1 complex assembly  factor 1;
  Uniprot ID:  Q5TC12;
  ENSP ID: ENSP00000443588
MVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 7019 - protein, 328 aa, Homo sapiens
  Payload ID: 1495;
  Gene Symbol: ATPAF1;
  Gene Name: ATP synthase mitochondrial F1 complex assembly  factor 1;
  Uniprot ID:  Q5TC12;
  ENSP ID: ENSP00000459167
MAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 7020 - protein, 351 aa, Homo sapiens; identical to SEQ ID NO: 7011
  Payload ID: 1495;
  Gene Symbol: ATPAF1;
  Gene Name: ATP synthase mitochondrial F1 complex assembly  factor 1;
  ENSP ID: ENSP00000460964

SEQ ID NO: 7021 - protein, 205 aa, Homo sapiens
  Payload ID: 1496;
  Gene Symbol: ATPAF2;
  Gene Name: ATP synthase mitochondrial F1 complex assembly  factor 2;
  ENSP ID: ENSP00000397198
MWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQ

SEQ ID NO: 7022 - protein, 289 aa, Homo sapiens
  Payload ID: 1496;
  Gene Symbol: ATPAF2;
  Gene Name: ATP synthase mitochondrial F1 complex assembly  factor 2;
  Uniprot ID:  Q8N5M1;
  ENSP ID: ENSP00000417190
MWRSCLRLRDGGRRLLNRPAGGPSASMSPGPTIPSPARAYAPPTERKRFYQNVSITQGEGGFEINLDHRKLKTPQAKLFTVPSEALAIAVATEWDSQQDTIKYYTMHLTTLCNTSLDNPTQRNKDQLIRAAVKFLDTDTICYRVEEPETLVELQRNEWDPIIEWAEKRYGVEISSSTSIMGPSIPAKTREVLVSHLASYNTWALQGIEFVAAQLKSMVLTLGLIDLRLTVEQAVLLSRLEEEYQIQKWGNIEWAHDYELQELRARTAAGTLFIHLCSESTTVKHKLLKE

SEQ ID NO: 7023 - protein, 107 aa, Homo sapiens
  Payload ID: 1496;
  Gene Symbol: ATPAF2;
  Gene Name: ATP synthase mitochondrial F1 complex assembly  factor 2;
  ENSP ID: ENSP00000462899
MWRSCLRLRDGGRRLLNRPAGGPSASMSPGPTIPSPARAYAPPTERKRFYQNVSITQGEDHIVQHIIGQPNPEKQGSADPGSREVSGHRHHLLQGGGARDISGTSKE

SEQ ID NO: 7024 - protein, 107 aa, Homo sapiens; identical to SEQ ID NO: 7023
  Payload ID: 1496;
  Gene Symbol: ATPAF2;
  Gene Name: ATP synthase mitochondrial F1 complex assembly  factor 2;
  ENSP ID: ENSP00000463861

SEQ ID NO: 7025 - protein, 107 aa, Homo sapiens; identical to SEQ ID NO: 7023
  Payload ID: 1496;
  Gene Symbol: ATPAF2;
  Gene Name: ATP synthase mitochondrial F1 complex assembly  factor 2;
  ENSP ID: ENSP00000463920

SEQ ID NO: 7026 - protein, 59 aa, Homo sapiens
  Payload ID: 1496;
  Gene Symbol: ATPAF2;
  Gene Name: ATP synthase mitochondrial F1 complex assembly  factor 2;
  ENSP ID: ENSP00000466008
  MOD_RES (1)..(1): Any amino acid
XLQRNEWDPIIEWAEKRSRSGATLSGPMTMSCRSCGPAPPPAPSSSISAPRAPQSSTSS

SEQ ID NO: 7027 - protein, 553 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  Uniprot ID:  P25705;
  ENSP ID: ENSP00000282050
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 7028 - protein, 553 aa, Homo sapiens; identical to SEQ ID NO: 7027
  Payload ID: 1497;
  Gene Symbol: ATP5A1;
  Gene Name: ATP synthase, H+ transporting, mitochondrial F1 complex, alpha subunit 1, cardiac muscle;
  Uniprot ID:  P25705;
  ENSP ID: ENSP00000381736

SEQ ID NO: 7029 - protein, 144 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000465259
MSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIK

SEQ ID NO: 7030 - protein, 503 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  Uniprot ID:  P25705;
  ENSP ID: ENSP00000465477
MSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 7031 - protein, 207 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000465497
MSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVA

SEQ ID NO: 7032 - protein, 44 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000465805
MLSVRVAAAVVRALPRRAGLNTFALGLQKCFGFIFHCCKELPCL

SEQ ID NO: 7033 - protein, 90 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000466275
MLSVRVAAAVVRALPRRAGLVSTEGRHDAGGRVGLQGGGAPARALSAGGRGAVANAAILHPWLLRLDRAGDTGALLLVTCAEAEWYRADS

SEQ ID NO: 7034 - protein, 58 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000466309
MLSVRVAAAVVRALPRRAGLVSRNALGSSFIAARNFHASNTHLQKTGKLLFLSLRRTY

SEQ ID NO: 7035 - protein, 199 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000466975
MLSVRVAAAVVRALPRRAGLVSRNALGSSFIAARNFHASNTHLQKTAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYL

SEQ ID NO: 7036 - protein, 531 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  Uniprot ID:  P25705;
  ENSP ID: ENSP00000467037
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 7037 - protein, 111 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000467830
MSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGK

SEQ ID NO: 7038 - protein, 78 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000467983
MVILWRKKKSPSRSPEMLWVHLSLLQGTSMPLTLIFKRLRWDFAVLARLVQTLGLKWSARLPKCWYYWREPLHPTPVC

SEQ ID NO: 7039 - protein, 205 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000468458
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRG

SEQ ID NO: 7040 - protein, 77 aa, Homo sapiens
  Payload ID: 1497;
  Gene Symbol: ATP5A1;
  Gene Name: ATP synthase, H+ transporting, mitochondrial F1 complex, alpha subunit 1, cardiac muscle;
  ENSP ID: ENSP00000468618
MLSVRVAAAVVRALPRRAGLVSRNALGSSFIAARNFHASNTHLQKTGTAEMSSILEERILGADTSVDLEETGRVLSW

SEQ ID NO: 7041 - protein, 529 aa, Homo sapiens
  Payload ID: 1498;
  Gene Symbol: ATP5B;
  Gene Name: ATP synthase, H+ transporting, mitochondrial F1 complex, beta polypeptide;
  Uniprot ID:  P06576;
  ENSP ID: ENSP00000262030
MLGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTEGLVRGQKVLDSGAPIKIPVGPETLGRIMNVIGEPIDERGPIKTKQFAPIHAEAPEFMEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 7042 - protein, 362 aa, Homo sapiens
  Payload ID: 1498;
  Gene Symbol: ATP5B;
  Gene Name: ATP synthase, H+ transporting, mitochondrial F1 complex, beta polypeptide;
  ENSP ID: ENSP00000446489
  MOD_RES (1)..(1): Any amino acid
XFVGRVAAAPASGALRRLTPSASLPPAQLLLRAAPTAVHPGESTVRTIAMDGTEGLVRGQKVLDSGAPIKIPVGPETLGRIMNVIGEPIDERGPIKTKQFAPIHAEAPEFMEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQ

SEQ ID NO: 7043 - protein, 284 aa, Homo sapiens
  Payload ID: 1498;
  Gene Symbol: ATP5B;
  Gene Name: ATP synthase, H+ transporting, mitochondrial F1 complex, beta polypeptide;
  ENSP ID: ENSP00000446677
MLGFVGRVAAAPASGALRRLTPSASLPPAQLLLRAAPTAVHPGESTVRTIAMDGTEGLVRGQKVLDSGAPIKIPVGPETLGRIMNVIGEPIDERGPIKTKQFAPIHAEAPEFMEMSVEQEILVTGIKVVDLLAPYAKGGKIGLFGGAGVGKTVLIMELINNVAKAHGGYSVFAGVGERTREGNDLYHEMIESGVINLKDATSKVSALLGRIPSAVGYQPTLATDMGTMQERITTTKKGSITSVQDYKSLQDIIAILGMDELSEEDKLTVSRARKIQRFLSQPFQ

SEQ ID NO: 7044 - protein, 270 aa, Homo sapiens
  Payload ID: 1498;
  Gene Symbol: ATP5B;
  Gene Name: ATP synthase, H+ transporting, mitochondrial F1 complex, beta polypeptide;
  ENSP ID: ENSP00000447571
MLGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTD

SEQ ID NO: 7045 - protein, 133 aa, Homo sapiens
  Payload ID: 1498;
  Gene Symbol: ATP5B;
  Gene Name: ATP synthase, H+ transporting, mitochondrial F1 complex, beta polypeptide;
  ENSP ID: ENSP00000448428
AGVGKTVLIMELINNVAKAHGGYSVFAGVGERTREGNDLYHEMIESGVINLKDATSKAGSEVSALLGRIPSAVGYQPTLATDMGTMQERITTTKKGSITSVQAIYVPADDLTDPAPATTFAHLDATTVLSRAI

SEQ ID NO: 7046 - protein, 168 aa, Homo sapiens
  Payload ID: 1499;
  Gene Symbol: ATP5D;
  Gene Name: ATP synthase, H+ transporting, mitochondrial F1 complex, delta subunit;
  Uniprot ID:  P30049;
  ENSP ID: ENSP00000215375
MLPAALLRRPGLGRLVRHARAYAEAAAAPAAASGPNQMSFTFASPTQVFFNGANVRQVDVPTLTGAFGILAAHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 7047 - protein, 168 aa, Homo sapiens; identical to SEQ ID NO: 7046
  Payload ID: 1499;
  Gene Symbol: ATP5D;
  Gene Name: ATP synthase, H+ transporting, mitochondrial F1 complex, delta subunit;
  Uniprot ID:  P30049;
  ENSP ID: ENSP00000378995

SEQ ID NO: 7048 - protein, 168 aa, Homo sapiens; identical to SEQ ID NO: 7046
  Payload ID: 1499;
  Gene Symbol: ATP5D;
  Gene Name: ATP synthase, H+ transporting, mitochondrial F1 complex, delta subunit;
  Uniprot ID:  P30049;
  ENSP ID: ENSP00000464863

SEQ ID NO: 7049 - protein, 99 aa, Homo sapiens
  Payload ID: 1499;
  Gene Symbol: ATP5D;
  Gene Name: ATP synthase, H+ transporting, mitochondrial F1 complex, delta subunit;
  ENSP ID: ENSP00000477964
  MOD_RES (1)..(1): Any amino acid
XGAFGILAAHVPTLQVLRPGLVVVHAEDGTTSKYFVSSGSIAVNADSSVQLLAEEAVTLDMLDLGPRQTWRRPRRSWWGQLTRPRGQRSRSESRPTRPW

SEQ ID NO: 7050 - protein, 51 aa, Homo sapiens
  Payload ID: 1500;
  Gene Symbol: ATP5E;
  Gene Name: ATP synthase, H+ transporting, mitochondrial F1 complex, epsilon subunit;
  Uniprot ID:  P56381;
  ENSP ID: ENSP00000243997
MVAYWRQAGLSYIRYSQICAKAVRDALKTEFKANAEKTSGSNVKIVKVKKE

SEQ ID NO: 7051 - protein, 51 aa, Homo sapiens; identical to SEQ ID NO: 7050
  Payload ID: 1500;
  Gene Symbol: ATP5E;
  Gene Name: ATP synthase, H+ transporting, mitochondrial F1 complex, epsilon subunit;
  Uniprot ID:  P56381;
  ENSP ID: ENSP00000379019

SEQ ID NO: 7052 - protein, 51 aa, Homo sapiens; identical to SEQ ID NO: 7050
  Payload ID: 1500;
  Gene Symbol: ATP5E;
  Gene Name: ATP synthase, H+ transporting, mitochondrial F1 complex, epsilon subunit;
  Uniprot ID:  P56381;
  ENSP ID: ENSP00000379023

SEQ ID NO: 7053 - protein, 51 aa, Homo sapiens
  Payload ID: 1501;
  Gene Symbol: ATP5EP2;
  Gene Name: ATP synthase, H+ transporting, mitochondrial F1 complex, epsilon subunit pseudogene 2;
  Uniprot ID:  Q5VTU8;
  ENSP ID: ENSP00000370414
MVAYWRQAGLSYIRYSQICAKVVRDALKTEFKANAKKTSGNSVKIVKVKKE

SEQ ID NO: 7054 - protein, 297 aa, Homo sapiens
  Payload ID: 1502;
  Gene Symbol: ATP5C1;
  Gene Name: ATP synthase, H+ transporting, mitochondrial F1 complex, gamma polypeptide 1;
  Uniprot ID:  P36542;
  ENSP ID: ENSP00000338568
MFSRAGVAGLSAWTLQPQWIQVRNMATLKDITRRLKSIKNIQKITKSMKMVAAAKYARAERELKPARIYGLGSLALYEKADIKGPEDKKKHLLIGVSSDRGLCGAIHSSIAKQMKSEVATLTAAGKEVMLVGIGDKIRGILYRTHSDQFLVAFKEVGRKPPTFGDASVIALELLNSGYEFDEGSIIFNKFRSVISYKTEEKPIFSLNTVASADSMSIYDDIDADVLQNYQEYNLANIIYYSLKESTTSEQSARMTAMDNASKNASEMIDKLTLTFNRTRQAVITKELIEIISGAAAL

SEQ ID NO: 7055 - protein, 298 aa, Homo sapiens
  Payload ID: 1502;
  Gene Symbol: ATP5C1;
  Gene Name: ATP synthase, H+ transporting, mitochondrial F1 complex, gamma polypeptide 1;
  Uniprot ID:  P36542;
  ENSP ID: ENSP00000349142
MFSRAGVAGLSAWTLQPQWIQVRNMATLKDITRRLKSIKNIQKITKSMKMVAAAKYARAERELKPARIYGLGSLALYEKADIKGPEDKKKHLLIGVSSDRGLCGAIHSSIAKQMKSEVATLTAAGKEVMLVGIGDKIRGILYRTHSDQFLVAFKEVGRKPPTFGDASVIALELLNSGYEFDEGSIIFNKFRSVISYKTEEKPIFSLNTVASADSMSIYDDIDADVLQNYQEYNLANIIYYSLKESTTSEQSARMTAMDNASKNASEMIDKLTLTFNRTRQAVITKELIEIISGAAALD

SEQ ID NO: 7056 - protein, 213 aa, Homo sapiens
  Payload ID: 1503;
  Gene Symbol: ATP5O;
  Gene Name: ATP synthase, H+ transporting, mitochondrial F1 complex, O subunit;
  Uniprot ID:  P48047;
  ENSP ID: ENSP00000290299
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPLTTNLINLLAENGRLSNTQGVVSAFSTMMSVHRGEVPCTVTSASPLEEATLSELKTVLKSFLSQGQVLKLEAKTDPSILGGMIVRIGEKYVDMSVKTKIQKLGRAMREIV

SEQ ID NO: 7057 - protein, 86 aa, Homo sapiens
  Payload ID: 1503;
  Gene Symbol: ATP5O;
  Gene Name: ATP synthase, H+ transporting, mitochondrial F1 complex, O subunit;
  ENSP ID: ENSP00000393211
  MOD_RES (1)..(1): Any amino acid
XTNLINLLAENGRLSNTQGVVSAFSTMMSVHRGEVPCTVTSASPLEEATLSELKTVLKSFLSQGQVLKLEAKSYFFCRLIRQSWVE

SEQ ID NO: 7058 - protein, 74 aa, Homo sapiens
  Payload ID: 1503;
  Gene Symbol: ATP5O;
  Gene Name: ATP synthase, H+ transporting, mitochondrial F1 complex, O subunit;
  ENSP ID: ENSP00000393496
  MOD_RES (1)..(1): Any amino acid
XAAPAVSGLSRQVRCFSTSVVRPFAKLVRPPVQVYGIEGRYATALYSAASKQNKLEQVEKELLRVAICLLKMVD

SEQ ID NO: 7059 - protein, 26 aa, Homo sapiens
  Payload ID: 1503;
  Gene Symbol: ATP5O;
  Gene Name: ATP synthase, H+ transporting, mitochondrial F1 complex, O subunit;
  ENSP ID: ENSP00000403964
  MOD_RES (1)..(1): Any amino acid
XGVVSAFSTMMSVHRGEVPCTVTSAS

SEQ ID NO: 7060 - protein, 40 aa, Homo sapiens
  Payload ID: 1503;
  Gene Symbol: ATP5O;
  Gene Name: ATP synthase, H+ transporting, mitochondrial F1 complex, O subunit;
  ENSP ID: ENSP00000407220
VVSAFSTMMSVHRGEVPCTVTSASACLELLGSSDPPALAS

SEQ ID NO: 7061 - protein, 256 aa, Homo sapiens
  Payload ID: 1504;
  Gene Symbol: ATP5F1;
  Gene Name: ATP synthase, H+ transporting, mitochondrial Fo complex, subunit B1;
  Uniprot ID:  P24539;
  ENSP ID: ENSP00000358737
MLSRVVLSAAATAAPSLKNAAFLGPGVLQATRTFHTGQPHLVPVPPLPEYGGKVRYGLIPEEFFQFLYPKTGVTGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 7062 - protein, 195 aa, Homo sapiens
  Payload ID: 1504;
  Gene Symbol: ATP5F1;
  Gene Name: ATP synthase, H+ transporting, mitochondrial Fo complex, subunit B1;
  ENSP ID: ENSP00000420366
MLSRVVLSAAATAGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 7063 - protein, 136 aa, Homo sapiens
  Payload ID: 1505;
  Gene Symbol: ATP5G1;
  Gene Name: ATP synthase, H+ transporting, mitochondrial Fo complex, subunit C1 (subunit 9);
  Uniprot ID:  P05496;
  ENSP ID: ENSP00000348205
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 7064 - protein, 136 aa, Homo sapiens; identical to SEQ ID NO: 7063
  Payload ID: 1505;
  Gene Symbol: ATP5G1;
  Gene Name: ATP synthase, H+ transporting, mitochondrial Fo complex, subunit C1 (subunit 9);
  Uniprot ID:  P05496;
  ENSP ID: ENSP00000377033

SEQ ID NO: 7065 - protein, 99 aa, Homo sapiens
  Payload ID: 1505;
  Gene Symbol: ATP5G1;
  Gene Name: ATP synthase, H+ transporting, mitochondrial Fo complex, subunit C1 (subunit 9);
  ENSP ID: ENSP00000422086
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYAR

SEQ ID NO: 7066 - protein, 110 aa, Homo sapiens
  Payload ID: 1505;
  Gene Symbol: ATP5G1;
  Gene Name: ATP synthase, H+ transporting, mitochondrial Fo complex, subunit C1 (subunit 9);
  ENSP ID: ENSP00000422950
MQTAGALFISPALPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 7067 - protein, 127 aa, Homo sapiens
  Payload ID: 1505;
  Gene Symbol: ATP5G1;
  Gene Name: ATP synthase, H+ transporting, mitochondrial Fo complex, subunit C1 (subunit 9);
  ENSP ID: ENSP00000426094
MQTAGALFISPALIRCCTRGLIRPVSASFLNSPVNSSKQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 7068 - protein, 98 aa, Homo sapiens
  Payload ID: 1505;
  Gene Symbol: ATP5G1;
  Gene Name: ATP synthase, H+ transporting, mitochondrial Fo complex, subunit C1 (subunit 9);
  ENSP ID: ENSP00000458423
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYA

SEQ ID NO: 7069 - protein, 157 aa, Homo sapiens
  Payload ID: 1506;
  Gene Symbol: ATP5G2;
  Gene Name: ATP synthase, H+ transporting, mitochondrial Fo complex, subunit C2 (subunit 9);
  Uniprot ID:  Q06055;
  ENSP ID: ENSP00000340315
MPELILSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 7070 - protein, 198 aa, Homo sapiens
  Payload ID: 1506;
  Gene Symbol: ATP5G2;
  Gene Name: ATP synthase, H+ transporting, mitochondrial Fo complex, subunit C2 (subunit 9);
  Uniprot ID:  Q06055;
  ENSP ID: ENSP00000377878
MPELILYVAITLSVAERLVGPGHACAEPSFRSSRCSAPLCLLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 7071 - protein, 141 aa, Homo sapiens
  Payload ID: 1506;
  Gene Symbol: ATP5G2;
  Gene Name: ATP synthase, H+ transporting, mitochondrial Fo complex, subunit C2 (subunit 9);
  Uniprot ID:  Q06055;
  ENSP ID: ENSP00000447317
MFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 7072 - protein, 16 aa, Homo sapiens
  Payload ID: 1506;
  Gene Symbol: ATP5G2;
  Gene Name: ATP synthase, H+ transporting, mitochondrial Fo complex, subunit C2 (subunit 9);
  ENSP ID: ENSP00000447643
MGLFCLMVAFLILFAM

SEQ ID NO: 7073 - protein, 141 aa, Homo sapiens; identical to SEQ ID NO: 7071
  Payload ID: 1506;
  Gene Symbol: ATP5G2;
  Gene Name: ATP synthase, H+ transporting, mitochondrial Fo complex, subunit C2 (subunit 9);
  Uniprot ID:  Q06055;
  ENSP ID: ENSP00000448801

SEQ ID NO: 7074 - protein, 141 aa, Homo sapiens; identical to SEQ ID NO: 7071
  Payload ID: 1506;
  Gene Symbol: ATP5G2;
  Gene Name: ATP synthase, H+ transporting, mitochondrial Fo complex, subunit C2 (subunit 9);
  Uniprot ID:  Q06055;
  ENSP ID: ENSP00000473535

SEQ ID NO: 7075 - protein, 142 aa, Homo sapiens
  Payload ID: 1507;
  Gene Symbol: ATP5G3;
  Gene Name: ATP synthase, H+ transporting, mitochondrial Fo complex, subunit C3 (subunit 9);
  Uniprot ID:  P48201;
  ENSP ID: ENSP00000284727
MFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYARNPSLKQQLFSYAILGFALSEAMGLFCLMVAFLILFAM

SEQ ID NO: 7076 - protein, 142 aa, Homo sapiens; identical to SEQ ID NO: 7075
  Payload ID: 1507;
  Gene Symbol: ATP5G3;
  Gene Name: ATP synthase, H+ transporting, mitochondrial Fo complex, subunit C3 (subunit 9);
  Uniprot ID:  P48201;
  ENSP ID: ENSP00000376324

SEQ ID NO: 7077 - protein, 142 aa, Homo sapiens; identical to SEQ ID NO: 7075
  Payload ID: 1507;
  Gene Symbol: ATP5G3;
  Gene Name: ATP synthase, H+ transporting, mitochondrial Fo complex, subunit C3 (subunit 9);
  Uniprot ID:  P48201;
  ENSP ID: ENSP00000387317

SEQ ID NO: 7078 - protein, 161 aa, Homo sapiens
  Payload ID: 1508;
  Gene Symbol: ATP5H;
  Gene Name: ATP synthase, H+ transporting, mitochondrial Fo complex, subunit d;
  Uniprot ID:  O75947;
  ENSP ID: ENSP00000301587
MAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 7079 - protein, 137 aa, Homo sapiens
  Payload ID: 1508;
  Gene Symbol: ATP5H;
  Gene Name: ATP synthase, H+ transporting, mitochondrial Fo complex, subunit d;
  Uniprot ID:  O75947;
  ENSP ID: ENSP00000344230
MAGRKLALKTIDWVAFAEIIPQNQKAIASSLKSWNETLTSRLAALPENPPAIDWAYYKANVAKAGLVDDFEKKVKSCAEWVSLSKARIVEYEKEMEKMKNLIPFDQMTIEDLNEAFPETKLDKKKYPYWPHQPIENL

SEQ ID NO: 7080 - protein, 81 aa, Homo sapiens
  Payload ID: 1508;
  Gene Symbol: ATP5H;
  Gene Name: ATP synthase, H+ transporting, mitochondrial Fo complex, subunit d;
  ENSP ID: ENSP00000437996
MAGRKLALKTIDWVAFAEIIPQNQKAIASSLKSWNETLTSRLAALPENPPAIDWAYYKANVAKAGLVDDFEKKLSIIAKLS

SEQ ID NO: 7081 - protein, 69 aa, Homo sapiens
  Payload ID: 1509;
  Gene Symbol: ATP5I;
  Gene Name: ATP synthase, H+ transporting, mitochondrial Fo complex, subunit E;
  Uniprot ID:  P56385;
  ENSP ID: ENSP00000306003
MVPPVQVSPLIKLGRYSALFLGVAYGATRYNYLKPRAEEERRIAAEEKKKQDELKRIARELAEDDSILK

SEQ ID NO: 7082 - protein, 94 aa, Homo sapiens
  Payload ID: 1510;
  Gene Symbol: ATP5J2;
  Gene Name: ATP synthase, H+ transporting, mitochondrial Fo complex, subunit F2;
  Uniprot ID:  P56134;
  ENSP ID: ENSP00000292475
MASVGECPAPVPVKDKKLLEVKLGELPSWILMRDFSPSGIFGAFQRGYYRYYNKYINVKKGSISGITMVLACYVLFSYSFSYKHLKHERLRKYH

SEQ ID NO: 7083 - protein, 55 aa, Homo sapiens
  Payload ID: 1510;
  Gene Symbol: ATP5J2;
  Gene Name: ATP synthase, H+ transporting, mitochondrial Fo complex, subunit F2;
  Uniprot ID:  P56134;
  ENSP ID: ENSP00000352890
MASVGECPAPVPVKDKKLLEVKLGELPSWILMRDFSPSGIFGAFQREHERLRKYH

SEQ ID NO: 7084 - protein, 88 aa, Homo sapiens
  Payload ID: 1510;
  Gene Symbol: ATP5J2;
  Gene Name: ATP synthase, H+ transporting, mitochondrial Fo complex, subunit F2;
  Uniprot ID:  P56134;
  ENSP ID: ENSP00000377740
MASVVPVKDKKLLEVKLGELPSWILMRDFSPSGIFGAFQRGYYRYYNKYINVKKGSISGITMVLACYVLFSYSFSYKHLKHERLRKYH

SEQ ID NO: 7085 - protein, 98 aa, Homo sapiens
  Payload ID: 1510;
  Gene Symbol: ATP5J2;
  Gene Name: ATP synthase, H+ transporting, mitochondrial Fo complex, subunit F2;
  ENSP ID: ENSP00000407540
MASVVGIFSHSSVSVPVKDKKLLEVKLGELPSWILMRDFSPSGIFGAFQRGYYRYYNKYINVKKGSISGITMVLACYVLFSYSFSYKHLKHERLRKYH

SEQ ID NO: 7086 - protein, 49 aa, Homo sapiens
  Payload ID: 1510;
  Gene Symbol: ATP5J2;
  Gene Name: ATP synthase, H+ transporting, mitochondrial Fo complex, subunit F2;
  Uniprot ID:  P56134;
  ENSP ID: ENSP00000412149
MASVVPVKDKKLLEVKLGELPSWILMRDFSPSGIFGAFQREHERLRKYH

SEQ ID NO: 7087 - protein, 49 aa, Homo sapiens; identical to SEQ ID NO: 7086
  Payload ID: 1510;
  Gene Symbol: ATP5J2;
  Gene Name: ATP synthase, H+ transporting, mitochondrial Fo complex, subunit F2;
  Uniprot ID:  P56134;
  ENSP ID: ENSP00000418197

SEQ ID NO: 7088 - protein, 19 aa, Homo sapiens
  Payload ID: 1510;
  Gene Symbol: ATP5J2;
  Gene Name: ATP synthase, H+ transporting, mitochondrial Fo complex, subunit F2;
  ENSP ID: ENSP00000430398
MASVGECPAPGYYRYYNKY

SEQ ID NO: 7089 - protein, 108 aa, Homo sapiens
  Payload ID: 1511;
  Gene Symbol: ATP5J;
  Gene Name: ATP synthase, H+ transporting, mitochondrial Fo complex, subunit F6;
  Uniprot ID:  P18859;
  ENSP ID: ENSP00000284971
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 7090 - protein, 108 aa, Homo sapiens; identical to SEQ ID NO: 7089
  Payload ID: 1511;
  Gene Symbol: ATP5J;
  Gene Name: ATP synthase, H+ transporting, mitochondrial Fo complex, subunit F6;
  Uniprot ID:  P18859;
  ENSP ID: ENSP00000382959

SEQ ID NO: 7091 - protein, 108 aa, Homo sapiens; identical to SEQ ID NO: 7089
  Payload ID: 1511;
  Gene Symbol: ATP5J;
  Gene Name: ATP synthase, H+ transporting, mitochondrial Fo complex, subunit F6;
  Uniprot ID:  P18859;
  ENSP ID: ENSP00000382962

SEQ ID NO: 7092 - protein, 108 aa, Homo sapiens; identical to SEQ ID NO: 7089
  Payload ID: 1511;
  Gene Symbol: ATP5J;
  Gene Name: ATP synthase, H+ transporting, mitochondrial Fo complex, subunit F6;
  Uniprot ID:  P18859;
  ENSP ID: ENSP00000382965

SEQ ID NO: 7093 - protein, 108 aa, Homo sapiens; identical to SEQ ID NO: 7089
  Payload ID: 1511;
  Gene Symbol: ATP5J;
  Gene Name: ATP synthase, H+ transporting, mitochondrial Fo complex, subunit F6;
  Uniprot ID:  P18859;
  ENSP ID: ENSP00000382966

SEQ ID NO: 7094 - protein, 119 aa, Homo sapiens
  Payload ID: 1511;
  Gene Symbol: ATP5J;
  Gene Name: ATP synthase, H+ transporting, mitochondrial Fo complex, subunit F6;
  ENSP ID: ENSP00000382971
MILQRLFRFSSVIRSAVSVHLRRNIGVTAVAFNKELDPIQKLFVDKIREYKSKRQTSGGPVDASSEYQQELERELFKLKQMFGNADMNTFPTFKFEEHFSQHLRSWQPSRDDDILILSS

SEQ ID NO: 7095 - protein, 116 aa, Homo sapiens
  Payload ID: 1511;
  Gene Symbol: ATP5J;
  Gene Name: ATP synthase, H+ transporting, mitochondrial Fo complex, subunit F6;
  Uniprot ID:  P18859;
  ENSP ID: ENSP00000389649
MHCDGGISMILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 7096 - protein, 103 aa, Homo sapiens
  Payload ID: 1512;
  Gene Symbol: ATP5L;
  Gene Name: ATP synthase, H+ transporting, mitochondrial Fo complex, subunit G;
  Uniprot ID:  O75964;
  ENSP ID: ENSP00000300688
MAQFVRNLVEKTPALVNAAVTYSKPRLATFWYYAKVELVPPTPAEIPRAIQSLKKIVNSAQTGSFKQLTVKEAVLNGLVATEVLMWFYVGEIIGKRGIIGYDV

SEQ ID NO: 7097 - protein, 76 aa, Homo sapiens
  Payload ID: 1512;
  Gene Symbol: ATP5L;
  Gene Name: ATP synthase, H+ transporting, mitochondrial Fo complex, subunit G;
  ENSP ID: ENSP00000434865
MAQFVRNLVEKTPALVNAAVTYSKPRLATFWYYAKVELVPPTPAEIPRAIQSLKKIVNSAQTGSFKQLTVKKKSST

SEQ ID NO: 7098 - protein, 100 aa, Homo sapiens
  Payload ID: 1513;
  Gene Symbol: ATP5L2;
  Gene Name: ATP synthase, H+ transporting, mitochondrial Fo complex, subunit G2;
  Uniprot ID:  Q7Z4Y8;
  ENSP ID: ENSP00000421076
MAPFVRNLVEKTPALVNAAVTYLKPRLAAFWYYTTVELVPPTPAEIPRAIQSLKKIVSSAQTGSFKQLTVKEALLNGLVATEVSTWFYVREITGKRGIIG

SEQ ID NO: 7099 - protein, 127 aa, Homo sapiens
  Payload ID: 1514;
  Gene Symbol: ATP5S;
  Gene Name: ATP synthase, H+ transporting, mitochondrial Fo complex, subunit s (factor B);
  Uniprot ID:  Q99766;
  ENSP ID: ENSP00000245448
MCCAVSEQRLTCADQMMPFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMETSNICC

SEQ ID NO: 7100 - protein, 215 aa, Homo sapiens
  Payload ID: 1514;
  Gene Symbol: ATP5S;
  Gene Name: ATP synthase, H+ transporting, mitochondrial Fo complex, subunit s (factor B);
  Uniprot ID:  Q99766;
  ENSP ID: ENSP00000308334
MCCAVSEQRLTCADQMMPFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMEGLEHVEKIRLCKCHYIEDDCLLRLSQLENLQKTILEMEIISCGNITDKGIIALRHLRNLKYLLLSDLPGVREKENLVQAFKTALPSLELKLQLK

SEQ ID NO: 7101 - protein, 266 aa, Homo sapiens
  Payload ID: 1514;
  Gene Symbol: ATP5S;
  Gene Name: ATP synthase, H+ transporting, mitochondrial Fo complex, subunit s (factor B);
  ENSP ID: ENSP00000351258
MIRGSGAEACSNEDGCSEKGMKGVDYDRIRDVGPDRAASEWLLRCGAMVRYHGQERWQKDYNHLPTGPLDKYKIQAIDATDSCIMSIGFDHMEGLEHVEKIRLCKCHYIEDDCLLRLSQLENLQKTILEMEIISCGNITDKGIIALRHLRNLKYLLLSDLPGAGNPGPCVASGSSRTRAPLGFRERGLQETDVPGALVDRSYDLSPSAGMRMLELKATTAILKSRFQLSVPGGSLLFKQSPVGHSSISFWPYKAILRQSRAGDNQE

SEQ ID NO: 7102 - protein, 136 aa, Homo sapiens
  Payload ID: 1514;
  Gene Symbol: ATP5S;
  Gene Name: ATP synthase, H+ transporting, mitochondrial Fo complex, subunit s (factor B);
  Uniprot ID:  Q99766;
  ENSP ID: ENSP00000389246
MCCAVSEQRLTCADQMMPFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMGNYPIVLLIENADDLQ

SEQ ID NO: 7103 - protein, 14 aa, Homo sapiens
  Payload ID: 1514;
  Gene Symbol: ATP5S;
  Gene Name: ATP synthase, H+ transporting, mitochondrial Fo complex, subunit s (factor B);
  ENSP ID: ENSP00000451583
MCCAVSEQRLTCAG

SEQ ID NO: 7104 - protein, 1278 aa, Homo sapiens
  Payload ID: 1515;
  Gene Symbol: AGTPBP1;
  Gene Name: ATP/GTP binding prt 1;
  ENSP ID: ENSP00000338512
MRTGSAASSAAAAAAAAAASASPATGVCMKTPGGGRRGIRRDPGAEPGAAALRGPRQRPILSRLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 7105 - protein, 1226 aa, Homo sapiens
  Payload ID: 1515;
  Gene Symbol: AGTPBP1;
  Gene Name: ATP/GTP binding prt 1;
  Uniprot ID:  Q9UPW5;
  ENSP ID: ENSP00000349592
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 7106 - protein, 1186 aa, Homo sapiens
  Payload ID: 1515;
  Gene Symbol: AGTPBP1;
  Gene Name: ATP/GTP binding prt 1;
  Uniprot ID:  Q9UPW5;
  ENSP ID: ENSP00000365251
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 7107 - protein, 1238 aa, Homo sapiens
  Payload ID: 1515;
  Gene Symbol: AGTPBP1;
  Gene Name: ATP/GTP binding prt 1;
  Uniprot ID:  Q9UPW5;
  ENSP ID: ENSP00000487074
MRTGSAASSAAAAAAAAAASASPATGVCMKTPGGGRRGIRRDPGAEPGAAALRGPRQRPILSRLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 7108 - protein, 1032 aa, Homo sapiens
  Payload ID: 1516;
  Gene Symbol: AGBL1;
  Gene Name: ATP/GTP binding prt-like 1;
  ENSP ID: ENSP00000397173
MISKGGSEALLQTLVDTARTAPPDYDILLPLFRLLAKVGLRDKKIGRKALELEALDVTLILARKNLSHGQNLLHCLWALRVFASSVSMGAMLGINGAMELLFKVITPYTRKRTQAIRAATEVLAALLKSKSNGRRAVNRGYVTSLLGLHQDWHSHDTANAYVQIRRGLLLCLRHIAALRSGREAFLAAQGMEILFSTTQNCLDDKSMEPVISVVLQILRQCYPTSPLPLVTASSAYAFPVPGCITTEPPHDLPEEDFEDDGDDEVDKDSDTEDGKVEDDDLETDVNKLSSKPGLDRPEEELMQYEVMCLELSYSFEELQSKLGDDLNSEKTQYANHHHIPAAASSKQHCYSKDQSSCGQEREYAVQTSLLCRVKTGRSTVHLGSKKNPGVNLYQNVQSNSLRRDSSESEIPDIQASPKADAWDVDAIFCPRMSASFSNSTRTREVVKVIDKLLQTHLKRVPFHDPYLYMAKARRTSSVVDFKMMAFPDVWGHCPPPTTQPMLERKCGVQRIRIFEDIRRLIQPSDVINKVVFSLDEPWPLQDNASNCLRFFSKFESGNLRKAIQVREFEYDLLVNADVNSTQHQQWFYFKVSGMQAAIPYHFNIINCEKPNSQFNYGMQPTLYSVKEALLGKPTWIRTGHEICYYKNHYRQSTAVAGGASGKCYYTLTFAVTFPHSEDVCYLAYHYPYTYTALMTHLDILEKSVNLKEVYFRQDVLCQTLGGNPCPLVTITAMPESNSDEHLEQFRHRPYQVITARVHPGESNASWVMKGTLEFLVSSDPVARLLRENFIFKIIPMLNPDGVINGNHRCSLSGEDLNRQWLSPSAHLQPTIYHAKGLLYHLSSIGRSPVVFCDFHGHSQKKNVFLYGCSIKETLWQAACTVGTSTILEEVNYRTLPKILDKLAPAFTMSSCSFLVEKSRASTARVVVWREMGVSRSYTMESSYCGCNQGPYQCTQRLLERTKNERAHPVDGLQGLQFGTRELEEMGAMFCLGLLILELKSASCSHQLLAQAATLLSAEEDALDQHLQRDAPK

SEQ ID NO: 7109 - protein, 1066 aa, Homo sapiens
  Payload ID: 1516;
  Gene Symbol: AGBL1;
  Gene Name: ATP/GTP binding prt-like 1;
  Uniprot ID:  Q96MI9;
  ENSP ID: ENSP00000413001
MISKGGSEALLQTLVDTARTAPPDYDILLPLFRLLAKVGLRDKKIGRKALELEALDVTLILARKNLSHGQNLLHCLWALRVFASSVSMGAMLGINGAMELLFKVITPYTRKRTQAIRAATEVLAALLKSKSNGRRAVNRGYVTSLLGLHQDWHSHDTANAYVQIRRGLLLCLRHIAALRSGREAFLAAQGMEILFSTTQNCLDDKSMEPVISVVLQILRQCYPTSPLPLVTASSAYAFPVPGCITTEPPHDLPEEDFEDDGDDEVDKDSDTEDGKVEDDDLETDVNKLSSKPGLDRPEEELMQYEVMCLELSYSFEELQSKLGDDLNSEKTQYANHHHIPAAASSKQHCYSKDQSSCGQEREYAVQTSLLCRVKTGRSTVHLGSKKNPGVNLYQNVQSNSLRRDSSESEIPDIQASPKADAWDVDAIFCPRMSASFSNSTRTREVVKVIDKLLQTHLKRVPFHDPYLYMAKARRTSSVVDFKMMAFPDVWGHCPPPTTQPMLERKCGVQRIRIFEDIRRLIQPSDVINKVVFSLDEPWPLQDNASNCLRFFSKFESGNLRKAIQVREFEYDLLVNADVNSTQHQQWFYFKVSGMQAAIPYHFNIINCEKPNSQFNYGMQPTLYSVKEALLGKPTWIRTGHEICYYKNHYRQSTAVAGGASGKCYYTLTFAVTFPHSEDVCYLAYHYPYTYTALMTHLDILEKSVNLKEVYFRQDVLCQTLGGNPCPLVTITAMPESNSDEHLEQFRHRPYQVITARVHPGESNASWVMKGTLEFLVSSDPVARLLRENFIFKIIPMLNPDGVINGNHRCSLSGEDLNRQWLSPSAHLQPTIYHAKGLLYHLSSIGRSPVVFCDFHGHSQKKNVFLYGCSIKETLWQAACTVGTSTILEEVNYRTLPKILDKLAPAFTMSSCSFLVEKSRASTARVVVWREMGVSRSYTMESSYCGCNQGPYQCTQRLLERTKNERAHPVDGLQGLQFGTRELEEMGAMFCLGLLILELKSASCSHQLLAQAATLLSAEEDALDQHLQRLKSSNFLPKHIWFAYHFFAITNFFKMNLLLHVSPVCDT

SEQ ID NO: 7110 - protein, 904 aa, Homo sapiens
  Payload ID: 1517;
  Gene Symbol: AGBL2;
  Gene Name: ATP/GTP binding prt-like 2;
  ENSP ID: ENSP00000350228
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPASAFRVAGITDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESRNSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 7111 - protein, 32 aa, Homo sapiens
  Payload ID: 1517;
  Gene Symbol: AGBL2;
  Gene Name: ATP/GTP binding prt-like 2;
  ENSP ID: ENSP00000431835
MFPALETHLKQTIPDPYEDFMYRHLQYYGYFK

SEQ ID NO: 7112 - protein, 126 aa, Homo sapiens
  Payload ID: 1517;
  Gene Symbol: AGBL2;
  Gene Name: ATP/GTP binding prt-like 2;
  ENSP ID: ENSP00000431912
  MOD_RES (1)..(1): Any amino acid
XQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKSSLFTVVILRSKNAKKEQDELLCGGWES

SEQ ID NO: 7113 - protein, 61 aa, Homo sapiens
  Payload ID: 1517;
  Gene Symbol: AGBL2;
  Gene Name: ATP/GTP binding prt-like 2;
  ENSP ID: ENSP00000432090
MFPALETHLKQTIPDPYEDFMYRHLQYYGYFKGSRSVTQAGGQWPPHPRLKQPSQPLAIIF

SEQ ID NO: 7114 - protein, 148 aa, Homo sapiens
  Payload ID: 1517;
  Gene Symbol: AGBL2;
  Gene Name: ATP/GTP binding prt-like 2;
  ENSP ID: ENSP00000432264
MYRHLQYYGYFKAQRGSLPNSATHQHVRKNNPQCLLNGSLGEKDDLIPDTLQKEKLLWPISLSSAVHRQIEAINRDSHMLSLPHLRSRQLLYDELDEVNPRLREPQELFSILSTKRPLQAPRWPIECEVIKENIHHIEWAPPQPEYFY

SEQ ID NO: 7115 - protein, 902 aa, Homo sapiens
  Payload ID: 1517;
  Gene Symbol: AGBL2;
  Gene Name: ATP/GTP binding prt-like 2;
  Uniprot ID:  Q5U5Z8;
  ENSP ID: ENSP00000435582
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPASAFRVAGITDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 7116 - protein, 331 aa, Homo sapiens
  Payload ID: 1517;
  Gene Symbol: AGBL2;
  Gene Name: ATP/GTP binding prt-like 2;
  ENSP ID: ENSP00000436063
MFPALETHLKQTIPDPYEDFMYRHLQYYGYFKAQRGSLPNSATHQHVRKNNPQCLLNGSLGEKDDLIPDTLQKEKLLYSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQ

SEQ ID NO: 7117 - protein, 95 aa, Homo sapiens
  Payload ID: 1517;
  Gene Symbol: AGBL2;
  Gene Name: ATP/GTP binding prt-like 2;
  ENSP ID: ENSP00000436518
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINR

SEQ ID NO: 7118 - protein, 824 aa, Homo sapiens
  Payload ID: 1517;
  Gene Symbol: AGBL2;
  Gene Name: ATP/GTP binding prt-like 2;
  ENSP ID: ENSP00000436630
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNEVVFLFLTLCHTDSLTSRISTSLPQCDKCNSHLRYPNLTVPLGARKH

SEQ ID NO: 7119 - protein, 621 aa, Homo sapiens
  Payload ID: 1518;
  Gene Symbol: AGBL3;
  Gene Name: ATP/GTP binding prt-like 3;
  Uniprot ID:  Q8NEM8;
  ENSP ID: ENSP00000275763
MSEDSEKEDYSDRTISDEDESDEDMFMKFVSEDLHRCALLTADSFGDPFFPRTTQILLEYQLGRWVPRLREPRDLYGVSSSGPLSPTRWPYHCEVIDEKVQHIDWTPSCPEPVYIPTGLETEPLYPDSKEATVVYLAEDAYKEPCFVYSRVGGNRTPLKQPVDYRDNTLMFEARFESGNLQKVVKVAEYEYQLTVRPDLFTNKHTQWYYFQVTNMRAGIVYRFTIVNFTKPASLYSRGMRPLFYSEKEAKAHHIGWQRIGDQIKYYRNNPGQDGRHYFSLTWTFQFPHNKDTCYFAHCYPYTYTNLQEYLSGINNDPVRSKFCKIRVLCHTLARNMVYILTITTPLKNSDSRKRKAVILTARVHPGETNSSWIMKGFLDYILGNSSDAQLLRDTFVFKVVPMLNPDGVIVGNYRCSLAGRDLNRNYTSLLKESFPSVWYTRNMVHRLMEKREVILYCDLHGHSRKENIFMYGCDGSDRSKTLYLQQRIFPLMLSKNCPDKFSFSACKFNVQKSKEGTGRVVMWKMGIRNSFTMEATFCGSTLGNKRGTHFSTKDLESMGYHFCDSLLDYCDPDRTKYYRCLKELEEMERHITLEKVFEDSDTPVIDITLDVESRELTFLLR

SEQ ID NO: 7120 - protein, 920 aa, Homo sapiens
  Payload ID: 1518;
  Gene Symbol: AGBL3;
  Gene Name: ATP/GTP binding prt-like 3;
  Uniprot ID:  Q8NEM8;
  ENSP ID: ENSP00000388275
MSEDSEKEDYSDRTISDEDESDEDMFMKFVSEDLHRCALLTADSFGDPFFPRTTQILLEYQLGRWVPRLREPRDLYGVSSSGPLSPTRWPYHCEVIDEKVQHIDWTPSCPEPVYIPTGLETEPLYPDSKEATVVYLAEDAYKEPCFVYSRVGGNRTPLKQPVDYRDNTLMFEARFESGNLQKVVKVAEYEYQLTVRPDLFTNKHTQWYYFQVTNMRAGIVYRFTIVNFTKPASLYSRGMRPLFYSEKEAKAHHIGWQRIGDQIKYYRNNPGQDGRHYFSLTWTFQFPHNKDTCYFAHCYPYTYTNLQEYLSGINNDPVRSKFCKIRVLCHTLARNMVYILTITTPLKNSDSRKRKAVILTARVHPGETNSSWIMKGFLDYILGNSSDAQLLRDTFVFKVVPMLNPDGVIVGNYRCSLAGRDLNRNYTSLLKESFPSVWYTRNMVHRLMEKREVILYCDLHGHSRKENIFMYGCDGSDRSKTLYLQQRIFPLMLSKNCPDKFSFSACKFNVQKSKEGTGRVVMWKMGIRNSFTMEATFCGSTLGNKRGTHFSTKDLESMGYHFCDSLLDYCDPDRTKYYRCLKELEEMERHITLEKVFEDSDTPVIDITLDVESSSRGSDSSESIDSLTYLLKLTSQKKHLKTKKERNSTIASHQNARGQEVYDRGHLLQRHTQSNSDVKDTRPNEPDDYMVDYFRRQLPNQGLDLHHNLKSKIKECISFQSKKTGINWTDDEKRSYKDKGIVQTQEILQYLLPIVHSTKNMQTTQIKQLFNPRTNFQIQHQLNPATCRNIKKYSTSWTAPRNHPFVIQGDVMANSSEWVQSKPHRSLESLSPLKGPKKNKHSQIWAIKNEDIKPLSSKWETASSSFGMDANVLKYKSLQAEETNQQSSKHTALHLTKNKDEQANKNDGQPTLYLKFQRES

SEQ ID NO: 7121 - protein, 704 aa, Homo sapiens
  Payload ID: 1518;
  Gene Symbol: AGBL3;
  Gene Name: ATP/GTP binding prt-like 3;
  ENSP ID: ENSP00000401220
MSEDSEKEDYSDRTISDEDESDEDMFMKFVSEDLHRCALLTADSFGDPFFPRTTQILLEYQLGRWVPRLREPRDLYGVSSSGPLSPTRWPYHCEVIDEKVQHIDWTPSCPEPVYIPTGLETEPLYPDSKEATVVYLAEDAYKEPCFVYSRVGGNRTPLKQPVDYRDNTLMFEARFESGNLQKVVKVAEYEYQLTVRPDLFTNKHTQWYYFQVTNMRAGIVYRFTIVNFTKPASLYSRGMRPLFYSEKEAKAHHIGWQRIGDQIKYYRNNPGQDGRHYFSLTWTFQFPHNKDTCYFAHCYPYTYTNLQEYLSGINNDPVRSKFCKIRVLCHTLARNMVYILTITTPLKNSDSRKRKAVILTARVHPGETNSSWIMKGFLDYILGNSSDAQLLRDTFVFKVVPMLNPDGVIVGNYRCSLAGRDLNRNYTSLLKESFPSVWYTRNMVHRLMEKREVILYCDLHGHSRKENIFMYGCDGSDRSKTLYLQQRIFPLMLSKNCPDKFSFSACKFNVQKSKEGTGRVVMWKMGIRNSFTMEATFCGSTLGNKRGTHFSTKDLESMGYHFCDSLLDYCDPDRTKYYRCLKELEEMERHITLEKVFEDSDTPVIDITLDVESSSRGSDSSESIDSLTYLLKLTSQKKHLKTKKERNSTIASHQNARGQEVYDRGHLLQRHTQSNSDVKDTRPNEPDDYMVDYFRRQLPNQGLV

SEQ ID NO: 7122 - protein, 93 aa, Homo sapiens
  Payload ID: 1518;
  Gene Symbol: AGBL3;
  Gene Name: ATP/GTP binding prt-like 3;
  ENSP ID: ENSP00000412700
MSEDSEKEDYSDRTISDEDESDEDMFMKFVSEDLHRCALLTDWTPSCPEPVYIPTGLETEPLYPDSKEATVVYLAEDGEHIMTHVAVKYNLVL

SEQ ID NO: 7123 - protein, 292 aa, Homo sapiens
  Payload ID: 1519;
  Gene Symbol: AGBL4;
  Gene Name: ATP/GTP binding prt-like 4;
  ENSP ID: ENSP00000335516
DNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTSFNRDAVKAGTGRRFLGGLLDHTSYCYTLEVSFYSYIISGTTAAVPYTEEAYMKLGRNVARTFLDYYRLNPVVEKVAIPMPRLRNKEIEVQRRKEKSPPYKHPLLRGPASNYPNSKGDKKSSVNHKDPSTPF

SEQ ID NO: 7124 - protein, 217 aa, Homo sapiens
  Payload ID: 1519;
  Gene Symbol: AGBL4;
  Gene Name: ATP/GTP binding prt-like 4;
  ENSP ID: ENSP00000360902
MAEGSQSAPEAGNDMGNDDAIGGNVSKYIVLPTGYCGQPKKGHLIFDACFESGNLGRVDQVSEFEYDLFIRPDTCNPRFRVWFNFTVENVKESQRVIFNIVNFSKTKSLYRDGMAPMVKSTSRPKWQRLPPKNVYYYRCPDHRKNYVMSFAFCFDREEDIYQFAYCYPYTYTRFQHYLDSLQKRNMDYFFREQLGQSVQQRKLDLLTITSPAGRWSW

SEQ ID NO: 7125 - protein, 320 aa, Homo sapiens
  Payload ID: 1519;
  Gene Symbol: AGBL4;
  Gene Name: ATP/GTP binding prt-like 4;
  ENSP ID: ENSP00000360904
MAEGSQSAPEAGNDMGNDDAIGGNVSKYIVLPTGYCGQPKKGHLIFDACFESGNLGRVDQVSEFEYDLFIRPDTCNPRFRVWFNFTVENVKESQRVIFNIVNFSKTKSLYRDGMAPMVKSTSRPKWQRLPPKNVYYYRCPDHRKNYVMSFAFCFDREEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPVSN

SEQ ID NO: 7126 - protein, 503 aa, Homo sapiens
  Payload ID: 1519;
  Gene Symbol: AGBL4;
  Gene Name: ATP/GTP binding prt-like 4;
  Uniprot ID:  Q5VU57;
  ENSP ID: ENSP00000360905
MAEGSQSAPEAGNDMGNDDAIGGNVSKYIVLPTGYCGQPKKGHLIFDACFESGNLGRVDQVSEFEYDLFIRPDTCNPRFRVWFNFTVENVKESQRVIFNIVNFSKTKSLYRDGMAPMVKSTSRPKWQRLPPKNVYYYRCPDHRKNYVMSFAFCFDREEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTSFNRDAVKAGTGRRFLGGLLDHTSYCYTLEVSFYSYIISGTTAAVPYTEEAYMKLGRNVARTFLDYYRLNPVVEKVAIPMPRLRNKEIEVQRRKEKSPPYKHPLLRGPASNYPNSKGDKKSSVNHKDPSTPF

SEQ ID NO: 7127 - protein, 299 aa, Homo sapiens
  Payload ID: 1519;
  Gene Symbol: AGBL4;
  Gene Name: ATP/GTP binding prt-like 4;
  ENSP ID: ENSP00000401622
  MOD_RES (1)..(1): Any amino acid
XREEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTSFNRDAVKAGTGRRFLGGLLDHTSYCYTLEVSFYSYIISGTTAAVPYTEEACILSPHPALGQPSSSREYPSLTGQELGPQLR

SEQ ID NO: 7128 - protein, 717 aa, Homo sapiens
  Payload ID: 1520;
  Gene Symbol: AGBL5;
  Gene Name: ATP/GTP binding prt-like 5;
  Uniprot ID:  Q8NDL9;
  ENSP ID: ENSP00000323681
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVRGKPVWEPLQHVFGCLGHCWGK

SEQ ID NO: 7129 - protein, 886 aa, Homo sapiens
  Payload ID: 1520;
  Gene Symbol: AGBL5;
  Gene Name: ATP/GTP binding prt-like 5;
  Uniprot ID:  Q8NDL9;
  ENSP ID: ENSP00000353249
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVREPRSQDRRRQQQPLNHRPAGSLAPSPAPTSSGPASSHKLGSCLLPDSFNIPGSSCSLLSSGDKPEAVMVIGKGLLGTGARMPCIKTRLQARPRLGRGSPPTRRGMKGSSGPTSPTPRTRESSELELGSCSATPGLPQARPPRPRSAPAFSPISCSLSDSPSWNCYSRGPLGQPEVCFVPKSPPLTVSPRV

SEQ ID NO: 7130 - protein, 157 aa, Homo sapiens
  Payload ID: 1520;
  Gene Symbol: AGBL5;
  Gene Name: ATP/GTP binding prt-like 5;
  ENSP ID: ENSP00000394730
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCY

SEQ ID NO: 7131 - protein, 65 aa, Homo sapiens
  Payload ID: 1520;
  Gene Symbol: AGBL5;
  Gene Name: ATP/GTP binding prt-like 5;
  ENSP ID: ENSP00000395266
MELRCGGLLFSSRFDSGNLAHVEKVESLSSDGEGVGGGASALTSGIASSPDYEFNVWTRPDCAET

SEQ ID NO: 7132 - protein, 25 aa, Homo sapiens
  Payload ID: 1520;
  Gene Symbol: AGBL5;
  Gene Name: ATP/GTP binding prt-like 5;
  ENSP ID: ENSP00000395721
MELRCGGLLFSSRFDSGNLAHVEKV

SEQ ID NO: 7133 - protein, 137 aa, Homo sapiens
  Payload ID: 1520;
  Gene Symbol: AGBL5;
  Gene Name: ATP/GTP binding prt-like 5;
  ENSP ID: ENSP00000400905
SSSSQQNSPQMKNSPSFPFHGSRPAGLPGLGSSTQKVTHRVLGPVREPRSQDRRRQQQPLNHRPAGSLAPSPAPTSSGPASSHKLGSCLLPDSFNIPGLYPLPLKSGFASLLHGQARFFKPSWETRGITYPLGILNL

SEQ ID NO: 7134 - protein, 66 aa, Homo sapiens
  Payload ID: 1520;
  Gene Symbol: AGBL5;
  Gene Name: ATP/GTP binding prt-like 5;
  ENSP ID: ENSP00000407584
MELRCGGLLFSSRFDSGNLAHVEKVESLSSDGEGVGGGASALTSGIASSPDYEFNVWTRPDCAETE

SEQ ID NO: 7135 - protein, 816 aa, Homo sapiens
  Payload ID: 1520;
  Gene Symbol: AGBL5;
  Gene Name: ATP/GTP binding prt-like 5;
  Uniprot ID:  Q8NDL9;
  ENSP ID: ENSP00000433830
MELRCGGLLFSSRFDSGNLAHVEKVESLSSDGEGVGGGASALTSGIASSPDYEFNVWTRPDCAETEFENGNRSWFYFSVRGGMPGKLIKINIMNMNKQSKLYSQGMAPFVRTLPTRPRWERIRDRPTFEMTETQFVLSFVHRFVEGRGATTFFAFCYPFSYSDCQELLNQLDQRFPENHPTHSSPLDTIYYHRELLCYSLDGLRVDLLTITSCHGLREDREPRLEQLFPDTSTPRPFRFAGKRIFFLSSRVHPGETPSSFVFNGFLDFILRPDDPRAQTLRRLFVFKLIPMLNPDGVVRGHYRTDSRGVNLNRQYLKPDAVLHPAIYGAKAVLLYHHVHSRLNSQSSSEHQPSSCLPPDAPVSDLEKANNLQNEAQCGHSADRHNAEAWKQTEPAEQKLNSVWIMPQQSAGLEESAPDTIPPKESGVAYYVDLHGHASKRGCFMYGNSFSDESTQVENMLYPKLISLNSAHFDFQGCNFSEKNMYARDRRDGQSKEGSGRVAIYKASGIIHSYTLECNYNTGRSVNSIPAACHDNGRASPPPPPAFPSRYTVELFEQVGRAMAIAALDMAECNPWPRIVLSEHSSLTNLRAWMLKHVRNSRGLSSTLNVGVNKKRGLRTPPKSHNGLPVSCSENTLSRARSFSTGTSAGGSSSSQQNSPQMKNSPSFPFHGSRPAGLPGLGSSTQKVTHRVLGPVREPRSQDRRRQQQPLNHRPAGSLAPSPAPTSSGPASSHKLGSCLLPDSFNIPGSSCSLLSSGDKPEAVMVIGKGLLGTGARMPCIKTRLQTCPRRVSARRGPGFPRLGPGWAGAHRRLAEG

SEQ ID NO: 7136 - protein, 749 aa, Homo sapiens
  Payload ID: 1521;
  Gene Symbol: ATP5J2-PTCD1;
  Gene Name: ATP5J2-PTCD1 readthrough;
  ENSP ID: ENSP00000400168
MASVVPVKDKKLLEVKLGELPSWILMRDFSPSGIFGAFQRGPGGTGKPEMDFVRLARLFARARPMGLFILQHLDPCRARWAGGREGLMRPMWAPFSSSSSQLPLGQERQENTGSLGSDPSHSNSTATQEEDEEEEESFGTLSDKYSSRRLFRKSAAQFHNLRFGERRDEQMEPEPKLWRGRRNTPYWYFLQCKHLIKEGKLVEALDLFERQMLKEERLQPMESNYTVLIGGCGRVGYLKKAFNLYNQMKKRDLEPSDATYTALFNVCAESPWKDSALQSALKLRQQLQAKNFELNLKTYHALLKMAAKCADLRMCLDVFKEIIHKGHVVTEETFSFLLMGCIQDKKTGFRYALQVWRLMLSLGLQPSRDSYNLLLVAARDCGLGDPQVASELLLKPREEATVLQPPVSRQRPRRTAQAKAGNLMSAMLHVEALERQLFLEPSQALGPPEPPEARVPGKAQPEVDTKAEPSHTAALTAVALKPPPVELEVNLLTPGAVPPTVVSFGTVTTPADRLALIGGLEGFLSKMAEHRQQPDIRTLTLLAEVVESGSPAESLLLALLDEHQVEADLTFFNTLVRKKSKLGDLEGAKALLPVLAKRGLVPNLQTFCNLAIGCHRPKDGLQLLTDMKKSQVTPNTHIYSALINAAIRKLNYTYLISILKDMKQNRVPVNEVVIRQLEFAAQYPPTFDRYQGKNTYLEKIDGFRAYYKQWLTVMPAEETPHPWQKFRTKPQGDQDTGKEADDGCALGGR

SEQ ID NO: 7137 - protein, 54 aa, Homo sapiens
  Payload ID: 1521;
  Gene Symbol: ATP5J2-PTCD1;
  Gene Name: ATP5J2-PTCD1 readthrough;
  ENSP ID: ENSP00000416954
MASVVPVKDKKLLEVKLGELPSWILMRDFSPSGIFGAFQRGYGQAASVEGAYRL

SEQ ID NO: 7138 - protein, 257 aa, Homo sapiens
  Payload ID: 1522;
  Gene Symbol: ATP5SL;
  Gene Name: ATP5S-like;
  Uniprot ID:  Q9NW81;
  ENSP ID: ENSP00000221943
MAAPWASLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 7139 - protein, 191 aa, Homo sapiens
  Payload ID: 1522;
  Gene Symbol: ATP5SL;
  Gene Name: ATP5S-like;
  Uniprot ID:  Q9NW81;
  ENSP ID: ENSP00000301183
MWDLVLEDRRMNSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLRTSAGWTSRTSLPCPTLASLRYWWRRCCPIARLWESTGLRA

SEQ ID NO: 7140 - protein, 158 aa, Homo sapiens
  Payload ID: 1522;
  Gene Symbol: ATP5SL;
  Gene Name: ATP5S-like;
  Uniprot ID:  Q9NW81;
  ENSP ID: ENSP00000397413
MAAPWASLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLRTSAGWTSRTSLPCPTLASLRYWWRRCCPIARLWESTGLRA

SEQ ID NO: 7141 - protein, 263 aa, Homo sapiens
  Payload ID: 1522;
  Gene Symbol: ATP5SL;
  Gene Name: ATP5S-like;
  Uniprot ID:  Q9NW81;
  ENSP ID: ENSP00000403910
MWDLVLEDRRMNSLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 7142 - protein, 176 aa, Homo sapiens
  Payload ID: 1522;
  Gene Symbol: ATP5SL;
  Gene Name: ATP5S-like;
  ENSP ID: ENSP00000464907
MAAPWASLRLVAPMWNGRIRGIHRLGAAVAPEGNQKKKRTILQFLTNYFYDVEALRDYLLQREMYKILHLAGEATWSIRRRFRDKEWIRPDKYGHFSQEFWNFCEVPVEAVDAGDCDINYEGLDNLLRLKELQSLSLQRCCHVDDWCLSRLYPLADSLQELSLAGCPRISERGLAC

SEQ ID NO: 7143 - protein, 185 aa, Homo sapiens
  Payload ID: 1522;
  Gene Symbol: ATP5SL;
  Gene Name: ATP5S-like;
  Uniprot ID:  Q9NW81;
  ENSP ID: ENSP00000466485
MAAPWASLRLVAPMWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHFSQEFWNFCEVPVEAVDAGDCDINYEGLDNLRTSAGWTSRTSLPCPTLASLRYWWRRCCPIARLWESTGLRA

SEQ ID NO: 7144 - protein, 230 aa, Homo sapiens
  Payload ID: 1522;
  Gene Symbol: ATP5SL;
  Gene Name: ATP5S-like;
  Uniprot ID:  Q9NW81;
  ENSP ID: ENSP00000467205
MAAPWASLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEVVGVDWAEGLKSGPEEQPRDTASPVPA

SEQ ID NO: 7145 - protein, 178 aa, Homo sapiens
  Payload ID: 1522;
  Gene Symbol: ATP5SL;
  Gene Name: ATP5S-like;
  ENSP ID: ENSP00000468059
MWDLVLEDRRMNSLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQ

SEQ ID NO: 7146 - protein, 101 aa, Homo sapiens
  Payload ID: 1522;
  Gene Symbol: ATP5SL;
  Gene Name: ATP5S-like;
  ENSP ID: ENSP00000468796
MWNGRIRGIHRLGAAVAPEGNQKKKRTILQFLTNYFYDVEALRDYLLQREMYKVHEKNRSYTWLEKQHGPYGAGAFFILKQGGAVKFRDKEWIRPDKYGHF

SEQ ID NO: 7147 - protein, 22 aa, Homo sapiens
  Payload ID: 1522;
  Gene Symbol: ATP5SL;
  Gene Name: ATP5S-like;
  ENSP ID: ENSP00000468966
MWDLVLEDRRMNVSRQGVDQAR

SEQ ID NO: 7148 - protein, 172 aa, Homo sapiens
  Payload ID: 1522;
  Gene Symbol: ATP5SL;
  Gene Name: ATP5S-like;
  ENSP ID: ENSP00000470444
MAAPWASLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQ

SEQ ID NO: 7149 - protein, 150 aa, Homo sapiens
  Payload ID: 1522;
  Gene Symbol: ATP5SL;
  Gene Name: ATP5S-like;
  ENSP ID: ENSP00000470684
  MOD_RES (1)..(1): Any amino acid
XYGAGAFFILKQGGAVKFRDKEWIRPDKYGHFSQEFWNFCEVPVEAVDAGDCDINYEGLDNLLRLKELQSLSLQRCCHVDDWCLSRLYPLADSLQELSLAGCPRISERGLACLHHLQNLRRLDISDLPAVSNPGLTQILVEEMLPNCEGP

SEQ ID NO: 7150 - protein, 121 aa, Homo sapiens
  Payload ID: 1522;
  Gene Symbol: ATP5SL;
  Gene Name: ATP5S-like;
  ENSP ID: ENSP00000471068
MAAPWASLRLVAPMWNGRIRGIHRLGAAVAPEGNQKKKRTILQFLTNYFYDVEALRDYLLQREMYKVHEKNRFRDKEWIRPDKYGHFSQEFWNFCEVPVEAVDAGDCDINYEGLDNLLKTV

SEQ ID NO: 7151 - protein, 99 aa, Homo sapiens
  Payload ID: 1523;
  Gene Symbol: ATP6V1G2-DDX39B;
  Gene Name: ATP6V1G2-DDX39B readthrough (NMD candidate);
  ENSP ID: ENSP00000365356
MASQSQGIQQLLQAEKRAAEKVADARKRKARRLKQAKEEAQMEVEQYRREREHEFQSKQQATGIFQRQAWSARICITAEGPVSGPLRLRSCSQEGGRLE

SEQ ID NO: 7152 - protein, 99 aa, Homo sapiens; identical to SEQ ID NO: 7151
  Payload ID: 1523;
  Gene Symbol: ATP6V1G2-DDX39B;
  Gene Name: ATP6V1G2-DDX39B readthrough (NMD candidate);
  ENSP ID: ENSP00000420191

SEQ ID NO: 7153 - protein, 361 aa, Homo sapiens
  Payload ID: 1524;
  Gene Symbol: ATAD1;
  Gene Name: ATPase family, AAA domain containing 1;
  Uniprot ID:  Q8NBU5;
  ENSP ID: ENSP00000339016
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 7154 - protein, 361 aa, Homo sapiens; identical to SEQ ID NO: 7153
  Payload ID: 1524;
  Gene Symbol: ATAD1;
  Gene Name: ATPase family, AAA domain containing 1;
  Uniprot ID:  Q8NBU5;
  ENSP ID: ENSP00000339017

SEQ ID NO: 7155 - protein, 361 aa, Homo sapiens; identical to SEQ ID NO: 7153
  Payload ID: 1524;
  Gene Symbol: ATAD1;
  Gene Name: ATPase family, AAA domain containing 1;
  ENSP ID: ENSP00000489353

SEQ ID NO: 7156 - protein, 361 aa, Homo sapiens; identical to SEQ ID NO: 7153
  Payload ID: 1524;
  Gene Symbol: ATAD1;
  Gene Name: ATPase family, AAA domain containing 1;
  ENSP ID: ENSP00000489455

SEQ ID NO: 7157 - protein, 1390 aa, Homo sapiens
  Payload ID: 1525;
  Gene Symbol: ATAD2;
  Gene Name: ATPase family, AAA domain containing 2;
  Uniprot ID:  Q6PL18;
  ENSP ID: ENSP00000287394
MVVLRSSLELHNHSAASATGSLDLSSDFLSLEHIGRRRLRSAGAAQKKPAATTAKAGDGSSVKEVETYHRTRALRSLRKDAQNSSDSSFEKNVEITEQLANGRHFTRQLARQQADKKKEEHREDKVIPVTRSLRARNIVQSTEHLHEDNGDVEVRRSCRIRSRYSGVNQSMLFDKLITNTAEAVLQKMDDMKKMRRQRMRELEDLGVFNETEESNLNMYTRGKQKDIQRTDEETTDNQEGSVESSEEGEDQEHEDDGEDEDDEDDDDDDDDDDDDDDEDDEDEEDGEEENQKRYYLRQRKATVYYQAPLEKPRHQRKPNIFYSGPASPARPRYRLSSAGPRSPYCKRMNRRRHAIHSSDSTSSSSSEDEQHFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHSSIVSTLLALMDGLDSRGEIVVIGATNRLDSIDPALRRPGRFDREFLFSLPDKEARKEILKIHTRDWNPKPLDTFLEELAENCVGYCGADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 7158 - protein, 708 aa, Homo sapiens
  Payload ID: 1525;
  Gene Symbol: ATAD2;
  Gene Name: ATPase family, AAA domain containing 2;
  ENSP ID: ENSP00000429213
MQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 7159 - protein, 64 aa, Homo sapiens
  Payload ID: 1525;
  Gene Symbol: ATAD2;
  Gene Name: ATPase family, AAA domain containing 2;
  ENSP ID: ENSP00000429331
MVVLRSSLELHNHSAASATGSLDLSSDFLSLEHIGRRRLRSAGAAQKKPAATTAKAGAVGQTAG

SEQ ID NO: 7160 - protein, 63 aa, Homo sapiens
  Payload ID: 1525;
  Gene Symbol: ATAD2;
  Gene Name: ATPase family, AAA domain containing 2;
  ENSP ID: ENSP00000429617
MVVLRSSLELHNHSAASATGSLDLSSDFLSLEHIGRRRLRSAGAAQKKPAATTAKAGVRWVIS

SEQ ID NO: 7161 - protein, 1458 aa, Homo sapiens
  Payload ID: 1526;
  Gene Symbol: ATAD2B;
  Gene Name: ATPase family, AAA domain containing 2B;
  Uniprot ID:  Q9ULI0;
  ENSP ID: ENSP00000238789
MVNTRKSSLRLLGSKSPGPGPGPGAGAEPGATGGSSHFISSRTRSSKTRAASCPAAKAGGSGGAGVTLDEARKVEVDGSLSDSHVSPPAKRTLKQPDSVCKDKSKSRSTGQREEWNLSTGQARLTSQPGATLPNGHSGLSLRSHPLRGEKKGDGDLSCINGDMEVRKSCRSRKNRFESVNQSLLFDQLVNSTAEAVLQEMDNINIRRNRRSGEVERLRMWTDTEFENMDMYSRVKRRRKSLRRNSYGIQNHHEVSTEGEEEESQEEDGDIEVEEAEGEENDRPYNLRQRKTVDRYQAPPIVPAHQKKRENTLFDIHRSPARRSHIRRKKHAIHSSDTTSSDEERFERRKSKSMARARNRCLPMNFRAEDLASGILRERVKVGASLADVDPMNIDKSVRFDSIGGLSHHIHALKEMVVFPLLYPEIFEKFKIQPPRGCLFYGPPGTGKTLVARALANECSQGDKKVAFFMRKGADCLSKWVGESERQLRLLFDQAYLMRPSIIFFDEIDGLAPVRSSRQDQIHSSIVSTLLALMDGLDNRGEIVVIGATNRLDSIDPALRRPGRFDREFLFNLPDQKARKHILQIHTRDWNPKLSDAFLGELAEKCVGYCGADIKALCTEAALIALRRRYPQIYASSHKLQLDVSSIVLSAQDFYHAMQNIVPASQRAVMSSGHALSPIIRPLLERSFNNILAVLQKVFPHAEISQSDKKEDIETLILEDSEDENALSIFETNCHSGSPKKQSSSAAIHKPYLHFTMSPYHQPTSYRPRLLLSGERGSGQTSHLAPALLHTLERFSVHRLDLPALYSVSAKTPEESCAQIFREARRTVPSIVYMPHIGDWWEAVSETVRATFLTLLQDIPSFSPIFLLSTSETMYSELPEEVKCIFRIQYEEVLYIQRPIEEDRRKFFQELILNQASMAPPRRKHAALCAMEVLPLALPSPPRQLSESEKSRMEDQEENTLRELRLFLRDVTKRLATDKRFNIFSKPVDIEEVSDYLEVIKEPMDLSTVITKIDKHNYLTAKDFLKDIDLICSNALEYNPDKDPGDKIIRHRACTLKDTAHAIIAAELDPEFNKLCEEIKEARIKRGLSVTSEQINPHSTGARKTETRVEEAFRHKQRNPMDVWHNSANKCAFRVRRKSRRRSQWGKGIIKKRKVNNLKKDEEDTKFADYENHTEDRKLLENGEFEVSTDCHEENGEETGDLSMTNDESSCDIMDLDQGQRLNNGAGTKENFASTEEESSNESLLVNSSSSLNPEQTSRKETFLKGNCLNGEASTDSFEGIPVLECQNGKLEVVSFCDSGDKCSSEQKILLEDQSKEKPETSTENHGDDLEKLEALECSNNEKLEPGSDVEVKDAELDKEGASKVKKYRKLILEQAKTTSLELVPEEPSEPVPPLIVDRERLKKLLDLLVDKSNNLAVDQLERLYSLLSQCIYRHRKDYDKSQLVEEMERTVHMFETFL

SEQ ID NO: 7162 - protein, 734 aa, Homo sapiens
  Payload ID: 1526;
  Gene Symbol: ATAD2B;
  Gene Name: ATPase family, AAA domain containing 2B;
  ENSP ID: ENSP00000370412
  MOD_RES (1)..(1): Any amino acid
XEDENALSIFETNCHSGSPKKQSSSAAIHKPYLHFTMSPYHQPTSYRPRLLLSGERGSGQTSHLAPALLHTLERFSVHRLDLPALYSVSAKTPEESCAQIFREARRTVPSIVYMPHIGDWWEAVSETVRATFLTLLQDIPSFSPIFLLSTSETMYSELPEEVKCIFRIQYEEVLYIQRPIEEDRRKFFQELILNQASMAPPRRKHAALCAMEVLPLALPSPPRQLSESEKSRMEDQEENTLRELRLFLRDVTKRLATDKRFNIFSKPVSDYLEVIKEPMDLSTVITKIDKHNYLTAKDFLKDIDLICSNALEYNPDKDPGDKIIRHRACTLKDTAHAIIAAELDPEFNKLCEEIKEARIKRGLSVTSEQINPHSTGARKTETRVEEAFRHKQRNPMDVWHNSANKCAFRVRRKSRRRSQWGKGIIKKRKVNNLKKDEEDTKFADYENHTEDRKLLENGEFEVSTDCHEENGEETGDLSMTNDESSCDIMDLDQGQRLNNGAGTKENFASTEEESSNESLLVNSSSSLNPEQTSRKETFLKGNCLNGEASTDSFEGIPVLECQNGKLEVVSFCDSGDKCSSEQKILLEDQSKEKPETSTENHGDDLEKLEALECSNNEKLEPGSDVEVKDAELDKEGASKVKKYRKLILEQAKTTSLELVPEEPSEPVPPLIVDRERLKKLLDLLVDKSNNLAVDQLERLYSLLSQCIYRHRKDYDKSQLVEEMERTVHMFETFL

SEQ ID NO: 7163 - protein, 64 aa, Homo sapiens
  Payload ID: 1526;
  Gene Symbol: ATAD2B;
  Gene Name: ATPase family, AAA domain containing 2B;
  ENSP ID: ENSP00000392764
MRLPSLLSYRAVSKARKHILQIHTRDWNPKLSDAFLGELAEKCVGYCGADIKALCTEAALIALR

SEQ ID NO: 7164 - protein, 370 aa, Homo sapiens
  Payload ID: 1526;
  Gene Symbol: ATAD2B;
  Gene Name: ATPase family, AAA domain containing 2B;
  ENSP ID: ENSP00000403177
MVNTRKSSLRLLGSKSPGPGPGPGAGAEPGATGGSSHFISSRTRSSKTRAASCPAAKAGGSGGAGVTLDEARKVEVDGSLSDSHVSPPAKRTLKQPDSVCKDKSKSRSTGQREEWNLSTGQARLTSQPGATLPNGHSGLSLRSHPLRGEKKGDGDLSCINGDMEVRKSCRSRKNRFESVNQSLLFDQLVNSTAEAVLQEMDNINIRRNRRSGEVERLRMWTDTEFENMDMYSRVKRRRKSLRRNSYGIQNHHEVSTEGEEEARTSKLLPLEKISIESQEEDGDIEVEEAEGEENDRPYNLRQRKTVDRYQAPPIVPAHQKKRENTLFDIHRSPARRSHIRRKKHAIHSSDTTSSDEERFERRKSKSMARA

SEQ ID NO: 7165 - protein, 572 aa, Homo sapiens
  Payload ID: 1527;
  Gene Symbol: ATAD3A;
  Gene Name: ATPase family, AAA domain containing 3A;
  ENSP ID: ENSP00000339421
  MOD_RES (1)..(1): Any amino acid
XGALALAAPRRCRQPLPGRDCAPGAPPAGAVSRAGRIGLFPSPVCTSAAVRSGSGYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 7166 - protein, 634 aa, Homo sapiens
  Payload ID: 1527;
  Gene Symbol: ATAD3A;
  Gene Name: ATPase family, AAA domain containing 3A;
  Uniprot ID:  Q9NVI7;
  ENSP ID: ENSP00000368030
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKMRLEALSLLHTLVWAWSLCRAGAVQTQERLSGSASPEQVPAGECCALQEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 7167 - protein, 586 aa, Homo sapiens
  Payload ID: 1527;
  Gene Symbol: ATAD3A;
  Gene Name: ATPase family, AAA domain containing 3A;
  Uniprot ID:  Q9NVI7;
  ENSP ID: ENSP00000368031
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 7168 - protein, 201 aa, Homo sapiens
  Payload ID: 1527;
  Gene Symbol: ATAD3A;
  Gene Name: ATPase family, AAA domain containing 3A;
  ENSP ID: ENSP00000383631
KLALHSGMDYAIMTGGDVAPMGREGVTAMHKLFDWANTSRRGLLLFVDEADAFLRKRATEKISEDLRATLNAFLYRTGQHSNNPSHVSHGGSSPAGRPWLTPQARWAPRFMLVLASNQPEQFDWAINDRINEMVHFDLPGQEERERLVRMYFDKYVLKPATEGKQRLKLAQFDYGRKCSEVARLTEGMSGREIAQLAVSWQ

SEQ ID NO: 7169 - protein, 507 aa, Homo sapiens
  Payload ID: 1527;
  Gene Symbol: ATAD3A;
  Gene Name: ATPase family, AAA domain containing 3A;
  Uniprot ID:  Q9NVI7;
  ENSP ID: ENSP00000439290
MQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 7170 - protein, 648 aa, Homo sapiens
  Payload ID: 1528;
  Gene Symbol: ATAD3B;
  Gene Name: ATPase family, AAA domain containing 3B;
  Uniprot ID:  Q5T9A4;
  ENSP ID: ENSP00000311766
MSWLFGVNKGPKGEGAGPPPPLPPAQPGAEGGGDRGLGDRPAPKDKWSNFDPTGLERAAKAARELEHSRYAKEALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVETEARARAKAERENADIIREQIRLKASEHRQTVLESIRTAGTLFGEGFRAFVTDRDKVTATVAGLTLLAVGVYSAKNATAVTGRFIEARLGKPSLVRETSRITVLEALRHPIQVSRRLLSRPQDVLEGVVLSPSLEARVRDIAIATRNTKKNRGLYRHILLYGPPGTGKTLFAKKLALHSGMDYAIMTGGDVAPMGREGVTAMHKLFDWANTSRRGLLLFMDEADAFLRKRATEEISKDLRATLNAFLYHMGQHSNKFMLVLASNLPEQFDCAINSRIDVMVHFDLPQQEERERLVRLHFDNCVLKPATEGKRRLKLAQFDYGRKCSEVARLTEGMSGREIAQLAVSWQATAYASKDGVLTEAMMDACVQDAVQQYRQKMRWLKAEGPGRGVEHPLSGVQGETLTSWSLATDPSYPCLAGPCTFRICSWMGTGLCPGPLSPRMSCGGGRPFCPPGHPLL

SEQ ID NO: 7171 - protein, 411 aa, Homo sapiens
  Payload ID: 1529;
  Gene Symbol: ATAD3C;
  Gene Name: ATPase family, AAA domain containing 3C;
  Uniprot ID:  Q5T2N8;
  ENSP ID: ENSP00000368062
MSKDALNLAQMQEQTLQLEQQSKLKQLVNEDLRKQEESVQKHHQTFLESIRAAGTLFGEGFRAFVTDRDKVTATVAGLTLLAVGVYSAKNATAVTGRYIEARLGKPSLVRETSRITVLEALRHPIQQVSRRLLSRPQDVLEGVVLSPSLEARVRDIAIMTRNIKKNRGLYRHILLYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLILASCHPEQFDWAINACIDVMVHFDLPGQEERARLVRMYLNEYVLKPATEGKRRLKLAQFDYGRKCLEIARLTEGMSCRKIAQLAVSWQATAYASKDGVLTEAMMDACVQDFVQQHQQMMRWLKGERPGPEDEQPSS

SEQ ID NO: 7172 - protein, 131 aa, Homo sapiens
  Payload ID: 1529;
  Gene Symbol: ATAD3C;
  Gene Name: ATPase family, AAA domain containing 3C;
  ENSP ID: ENSP00000464661
MSKDALNLAQMQEQTLQLEQQSKLKQLVNEDLRKQEESVQKHHQTFLESIRAAGTLFGEGFRAFVTDRDKVTATQVSRRLLSRPQDVLEGVVLSPSLEARVRDIAIMTRNIKKNRGLYRHILLYGPPGTGK

SEQ ID NO: 7173 - protein, 1844 aa, Homo sapiens
  Payload ID: 1530;
  Gene Symbol: ATAD5;
  Gene Name: ATPase family, AAA domain containing 5;
  Uniprot ID:  Q96QE3;
  ENSP ID: ENSP00000313171
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSLQNSKKVNPKQGTTKNDFKKLRKRKCRDVVDLSESLPLAEELNLLKKDGKDTKQMENTTSHANSRDNVTEAAQLNDSIITVSYEEFLKSHKENKVEEIPDSTMSICVPSETVDEIVKSGYISESENSEISQQVRFKTVTVLAQVHPIPPKKTGKIPRIFLKQKQFEMENSLSDPENEQTVQKRKSNVVIQEEELELAVLEAGSSEAVKPKCTLEERQQFMKAFRQPASDALKNGVKKSSDKQKDLNEKCLYEVGRDDNSKKIMENSGIQMVSKNGNLQLHTDKGSFLKEKNKKLKKKNKKTLDTGAIPGKNREGNTQKKETTFFLKEKQYQNRMSLRQRKTEFFKSSTLFNNESLVYEDIANDDLLKVSSLCNNNKLSRKTSIPVKDIKLTQSKAESEASLLNVSTPKSTRRSGRISSTPTTETIRGIDSDDVQDNSQLKASTQKAANLSEKHSLYTAELITVPFDSESPIRMKFTRISTPKKSKKKSNKRSEKSEATDGGFTSQIRKASNTSKNISKAKQLIEKAKALHISRSKVTEEIAIPLRRSSRHQTLPERKKLSETEDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKDSGTEDMLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPKKISSPKKVVTSPRKVPPPSPKSSGPKRALPPKTLANYFKVSPKPKNNEEIGMLLENNKGIKNSFEQKQITQTKSTNATNSNVKDVGAEEPSRKNATSLILFEEVDVIFDEDAGFLNAIKTFMATTKRPVILTTSDPTFSLMFDGCFEEIKFSTPSLLNVASYLQMICLTENFRTDVKDFVTLLTANTCDIRKSILYLQFWIRSGGGVLEERPLTLYRGNSRNVQLVCSEHGLDNKIYPKNTKKKRVDLPKCDSGCAETLFGLKNIFSPSEDLFSFLKHKITMKEEWHKFIQLLTEFQMRNVDFLYSNLEFILPLPVDTIPETKNFCGPSVTVDASAATKSMNCLARKHSEREQPLKKSQKKKQKKTLVILDDSDLFDTDLDFPDQSISLSSVSSSSNAEESKTGDEESKARDKGNNPETKKSIPCPPKTTAGKKCSALVSHCLNSLSEFMDNMSFLDALLTDVREQNKYGRNDFSWTNGKVTSGLCDEFSLESNDGWTSQSSGELKAAAEALSFTKCSSAISKALETLNSCKKLGRDPTNDLTFYVSQKRNNVYFSQSAANLDNAWKRISVIKSVFSSRSLLYVGNRQASIIEYLPTLRNICKTEKLKEQGKSKRRFLHYFEGIHLDIPKETVNTLAADFP

SEQ ID NO: 7174 - protein, 1224 aa, Homo sapiens
  Payload ID: 1530;
  Gene Symbol: ATAD5;
  Gene Name: ATPase family, AAA domain containing 5;
  ENSP ID: ENSP00000463102
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSLQNSKKVNPKQGTTKNDFKKLRKRKCRDVVDLSESLPLAEELNLLKKDGKDTKQMENTTSHANSRDNVTEAAQLNDSIITVSYEEFLKSHKENKVEEIPDSTMSICVPSETVDEIVKSGYISESENSEISQQVRFKTVTVLAQVHPIPPKKTGKIPRIFLKQKQFEMENSLSDPENEQTVQKRKSNVVIQEEELELAVLEAGSSEAVKPKCTLEERQQFMKAFRQPASDALKNGVKKSSDKQKDLNEKCLYEVGRDDNSKKIMENSGIQMVSKNGNLQLHTDKGSFLKEKNKKLKKKNKKTLDTGAIPGKNREGNTQKKETTFFLKEKQYQNRMSLRQRKTEFFKSSTLFNNESLVYEDIANDDLLKVSSLCNNNKLSRKTSIPVKDIKLTQSKAESEASLLNVSTPKSTRRSGRISSTPTTETIRGIDSDDVQDNSQLKASTQKAANLSEKHSLYTAELITVPFDSESPIRMKFTRISTPKKSKKKSNKRSEKSEATDGGFTSQIRKASNTSKNISKAKQLIEKAKALHISRSKVTEEIAIPLRRSSRHQTLPERKKLSETEDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKDSGTEDMLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPKKISSPKKVVTSPRKVPPPSPK

SEQ ID NO: 7175 - protein, 106 aa, Homo sapiens
  Payload ID: 1531;
  Gene Symbol: ATPIF1;
  Gene Name: ATPase inhibitory  factor 1;
  Uniprot ID:  Q9UII2;
  ENSP ID: ENSP00000335203
MAVTALAARTWLGVWGVRTMQARGFGSDQSENVDRGAGSIREAGGAFGKREQAEEERYFRAQSREQLAALKKHHEEEIVHHKKEIERLQKEIERHKQKIKMLKHDD

SEQ ID NO: 7176 - protein, 75 aa, Homo sapiens
  Payload ID: 1531;
  Gene Symbol: ATPIF1;
  Gene Name: ATPase inhibitory  factor 1;
  ENSP ID: ENSP00000435341
MAVTALAARTWLGVWGVRTMQARGFGSDQSENVDRGAGSIREAGGAFGKREQAEEERYFRALGATFCFFAVEAVV

SEQ ID NO: 7177 - protein, 71 aa, Homo sapiens
  Payload ID: 1531;
  Gene Symbol: ATPIF1;
  Gene Name: ATPase inhibitory  factor 1;
  Uniprot ID:  Q9UII2;
  ENSP ID: ENSP00000435579
MAVTALAARTWLGVWGVRTMQARGFGSDQSENVDRGAGSIREAGGAFGKREQAEEERYFRHYRLCFEISLG

SEQ ID NO: 7178 - protein, 60 aa, Homo sapiens
  Payload ID: 1531;
  Gene Symbol: ATPIF1;
  Gene Name: ATPase inhibitory  factor 1;
  Uniprot ID:  Q9UII2;
  ENSP ID: ENSP00000437337
MAVTALAARTWLGVWGVRTMQARGFGSDQSENVDRGAGSIREAGGAFGKREQAEEERYFR

SEQ ID NO: 7179 - protein, 1086 aa, Homo sapiens
  Payload ID: 1532;
  Gene Symbol: ATP13A1;
  Gene Name: ATPase type 13A1;
  Uniprot ID:  Q9HD20;
  ENSP ID: ENSP00000291503
MEKWEELNSHQPGEEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 7180 - protein, 1204 aa, Homo sapiens
  Payload ID: 1532;
  Gene Symbol: ATP13A1;
  Gene Name: ATPase type 13A1;
  Uniprot ID:  Q9HD20;
  ENSP ID: ENSP00000349877
MAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 7181 - protein, 185 aa, Homo sapiens
  Payload ID: 1532;
  Gene Symbol: ATP13A1;
  Gene Name: ATPase type 13A1;
  ENSP ID: ENSP00000411891
  MOD_RES (1)..(1): Any amino acid
XASPWVPAAAFLSVTIATWATHLPGLDSQGHPLHFGAGLIMTPLLTCCACLEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYS

SEQ ID NO: 7182 - protein, 1180 aa, Homo sapiens
  Payload ID: 1533;
  Gene Symbol: ATP13A2;
  Gene Name: ATPase type 13A2;
  Uniprot ID:  Q9NQ11;
  ENSP ID: ENSP00000327214
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 7183 - protein, 1158 aa, Homo sapiens
  Payload ID: 1533;
  Gene Symbol: ATP13A2;
  Gene Name: ATPase type 13A2;
  Uniprot ID:  Q9NQ11;
  ENSP ID: ENSP00000341115
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNERARPVPPRLPAPPPAQAGLQEALQAAGTRAGRAALAAAARRPPEVVQAHGHPRHWNSLPLSHQLDPSPATPPPPPPTSLRLATVYTPPPRPPPPWGSVDYCPLPWTIPRRGGSPQLPSVLLSV

SEQ ID NO: 7184 - protein, 1175 aa, Homo sapiens
  Payload ID: 1533;
  Gene Symbol: ATP13A2;
  Gene Name: ATPase type 13A2;
  Uniprot ID:  Q9NQ11;
  ENSP ID: ENSP00000413307
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 7185 - protein, 258 aa, Homo sapiens
  Payload ID: 1533;
  Gene Symbol: ATP13A2;
  Gene Name: ATPase type 13A2;
  ENSP ID: ENSP00000421126
YSIFILYRNRVPLNEIVIRALDLVTVVVPPALPAAMTVCTLYAQSRLRRQGIFCIHPLRINLGGKLQLVCFDKVLEEEPAADSAFGTQVLAVMRPPLWEPQLQAMRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPAS

SEQ ID NO: 7186 - protein, 188 aa, Homo sapiens
  Payload ID: 1533;
  Gene Symbol: ATP13A2;
  Gene Name: ATPase type 13A2;
  ENSP ID: ENSP00000422227
  MOD_RES (1)..(1): Any amino acid
XIEIRDKEDSSWQLFTVQVQTEAIGEGSLEPSPQSQAEDGRSQAAVGAVPEGAWKDTAQLHKSEEAKRVLRYYLFQGQRYIWIETQQAFYQVSLLDHGRSCDDVHRSRHGLSLQDQMVRKAIYGPNVISIPVKSYPQLLVDEAFSIALWLADHYYWYALCIFLISSISICLSLYKTRKQSQTLRDMVK

SEQ ID NO: 7187 - protein, 190 aa, Homo sapiens
  Payload ID: 1533;
  Gene Symbol: ATP13A2;
  Gene Name: ATPase type 13A2;
  ENSP ID: ENSP00000422668
  MOD_RES (1)..(1): Any amino acid
XVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEARVLRYYLFQGQRYIWIETQQAFYQVSLLDHGRSCDDVHRSRHG

SEQ ID NO: 7188 - protein, 398 aa, Homo sapiens
  Payload ID: 1533;
  Gene Symbol: ATP13A2;
  Gene Name: ATPase type 13A2;
  ENSP ID: ENSP00000423065
DPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNERARPVPPRLPAPPPAQAGLQEALQAAGTRAGRAALAAAARRPPEVVQAHGHPRHWNSLPLSHQLDPSPATPPPPPPTSLRLATVYTPPPRPPPPWGSVDYCPLPWTIPRRGGSPQLPSVLLSV

SEQ ID NO: 7189 - protein, 321 aa, Homo sapiens
  Payload ID: 1533;
  Gene Symbol: ATP13A2;
  Gene Name: ATPase type 13A2;
  ENSP ID: ENSP00000424313
  MOD_RES (1)..(1): Any amino acid
XDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLT

SEQ ID NO: 7190 - protein, 191 aa, Homo sapiens
  Payload ID: 1533;
  Gene Symbol: ATP13A2;
  Gene Name: ATPase type 13A2;
  ENSP ID: ENSP00000424393
QSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGGLVSSILHPRPINFKFYKHSMKFVAALSVLALLGTIYSIFILYRNRVPLNEIVIRALDLVTVVVPPALPAAM

SEQ ID NO: 7191 - protein, 189 aa, Homo sapiens
  Payload ID: 1533;
  Gene Symbol: ATP13A2;
  Gene Name: ATPase type 13A2;
  ENSP ID: ENSP00000427241
DSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEAFSIALWLADHYYWYALCIFLISSISICLSLYKTRKQSQTLRDMVKLSMR

SEQ ID NO: 7192 - protein, 228 aa, Homo sapiens
  Payload ID: 1533;
  Gene Symbol: ATP13A2;
  Gene Name: ATPase type 13A2;
  ENSP ID: ENSP00000478781
MVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTALLGTIYSIFILYRNRVPLNEIVIRALDLVTVVVPPALPAAMTVCTLYAQSRLRRQGIFCIHPLRINLGGKLQLVCFDKVGPQVGLVQGSGTATGAPVRPPHPRYSLSSTHRMPGPV

SEQ ID NO: 7193 - protein, 1226 aa, Homo sapiens
  Payload ID: 1534;
  Gene Symbol: ATP13A3;
  Gene Name: ATPase type 13A3;
  Uniprot ID:  Q9H7F0;
  ENSP ID: ENSP00000256031
MDREERKTINQGQEDEMEIYGYNLSRWKLAIVSLGVICSGGFLLLLLYWMPEWRVKATCVRAAIKDCEVVLLRTTDEFKMWFCAKIRVLSLETYPVSSPKSMSNKLSNGHAVCLIENPTEENRHRISKYSQTESQQIRYFTHHSVKYFWNDTIHNFDFLKGLDEGVSCTSIYEKHSAGLTKGMHAYRKLLYGVNEIAVKVPSVFKLLIKEVLNPFYIFQLFSVILWSTDEYYYYALAIVVMSIVSIVSSLYSIRKQYVMLHDMVATHSTVRVSVCRVNEEIEEIFSTDLVPGDVMVIPLNGTIMPCDAVLINGTCIVNESMLTGESVPVTKTNLPNPSVDVKGIGDELYNPETHKRHTLFCGTTVIQTRFYTGELVKAIVVRTGFSTSKGQLVRSILYPKPTDFKLYRDAYLFLLCLVAVAGIGFIYTIINSILNEVQVGVIIIESLDIITITVPPALPAAMTAGIVYAQRRLKKIGIFCISPQRINICGQLNLVCFDKTGTLTEDGLDLWGIQRVENARFLSPEENVCNEMLVKSQFVACMATCHSLTKIEGVLSGDPLDLKMFEAIGWILEEATEEETALHNRIMPTVVRPPKQLLPESTPAGNQEMELFELPATYEIGIVRQFPFSSALQRMSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCVFKFMALYSIIQYFSVTLLYSILSNLGDFQFLFIDLAIILVVVFTMSLNPAWKELVAQRPPSGLISGALLFSVLSQIIICIGFQSLGFFWVKQQPWYEVWHPKSDACNTTGSGFWNSSHVDNETELDEHNIQNYENTTVFFISSFQYLIVAIAFSKGKPFRQPCYKNYFFVFSVIFLYIFILFIMLYPVASVDQVLQIVCVPYQWRVTMLIIVLVNAFVSITVEESVDRWGKCCLPWALGCRKKTPKAKYMYLAQELLVDPEWPPKPQTTTEAKALVKENGSCQIITIT

SEQ ID NO: 7194 - protein, 162 aa, Homo sapiens
  Payload ID: 1534;
  Gene Symbol: ATP13A3;
  Gene Name: ATPase type 13A3;
  ENSP ID: ENSP00000402550
  MOD_RES (1)..(1): Any amino acid
XPFRQPCYKNYFFVFSVIFLYIFILFIMLYPVASVDQVLQIVCVPYQWRVTMLIIVLVNAFVSITVENFFLDMVLWKVVFNRDKQGEYRFSTTQPPQESVDRWGKCCLPWALGCRKKTPKAKYMYLAQELLVDPEWPPKPQTTTEAKALVKENGSCQIITIT

SEQ ID NO: 7195 - protein, 102 aa, Homo sapiens
  Payload ID: 1534;
  Gene Symbol: ATP13A3;
  Gene Name: ATPase type 13A3;
  ENSP ID: ENSP00000406234
MDREERKTINQGQEDEMEIYGYNLSRWKLAIVSLGVICSGGFLLLLLYWMPEWRVKATCVRAAIKDCEVVLLRTTDEFKMWFCAKIRVLSLETYPVSSPKSM

SEQ ID NO: 7196 - protein, 46 aa, Homo sapiens
  Payload ID: 1534;
  Gene Symbol: ATP13A3;
  Gene Name: ATPase type 13A3;
  ENSP ID: ENSP00000410767
MDREERKTINQGQEDEMEIYGYNLSRWKLAIVSLGVICSGGFLLLL

SEQ ID NO: 7197 - protein, 1226 aa, Homo sapiens; identical to SEQ ID NO: 7193
  Payload ID: 1534;
  Gene Symbol: ATP13A3;
  Gene Name: ATPase type 13A3;
  Uniprot ID:  Q9H7F0;
  ENSP ID: ENSP00000416508

SEQ ID NO: 7198 - protein, 701 aa, Homo sapiens
  Payload ID: 1534;
  Gene Symbol: ATP13A3;
  Gene Name: ATPase type 13A3;
  ENSP ID: ENSP00000482200
ISEIEEIFSTDLVPGDVMVIPLNGTIMPCDAVLINGTCIVNESMLTGESVPVTKTNLPNPSVDVKGIGDELYNPETHKRHTLFCGTTVIQTRFYTGELVKAIVVRTGFSTSKGQLVRSILYPKPTDFKLYRDAYLFLLCLVAVAGIGFIYTIINSILNEVQVGVIIIESLDIITITVPPALPAAMTAGIVYAQRRLKKIGIFCISPQRINICGQLNLVCFDKTGTLTEDGLDLWGIQRVENARFLSPEENVCNEMLVKSQFVACMATCHSLTKIEGVLSGDPLDLKMFEAIGWILEEATEEETALHNRIMPTVVRPPKQLLPESTPAGNQEMELFELPATYEIGIVRQFPFSSALQRMSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCELALFSIVTYSLDHFIISILISNMLVLFFSDFHNCAFYSLV

SEQ ID NO: 7199 - protein, 576 aa, Homo sapiens
  Payload ID: 1535;
  Gene Symbol: ATP13A4;
  Gene Name: ATPase type 13A4;
  Uniprot ID:  Q4VNC1;
  ENSP ID: ENSP00000295548
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWVSLCSSENLRSFFNARAT

SEQ ID NO: 7200 - protein, 1196 aa, Homo sapiens
  Payload ID: 1535;
  Gene Symbol: ATP13A4;
  Gene Name: ATPase type 13A4;
  Uniprot ID:  Q4VNC1;
  ENSP ID: ENSP00000339182
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQYVGVLLLYWETNSLSNYQFLFQDLAITTLIGVTMNLNGAYPKLVPFRPAGRLISPPLLLSVIFNILLSLAMHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 7201 - protein, 1177 aa, Homo sapiens
  Payload ID: 1535;
  Gene Symbol: ATP13A4;
  Gene Name: ATPase type 13A4;
  ENSP ID: ENSP00000376238
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQYVGVLLLYWETNSLSNYQFLFQDLAITTLIGVTMNLNGAYPKLVPFRPAGRLISPPLLLSVIFNILLSLAMHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 7202 - protein, 212 aa, Homo sapiens
  Payload ID: 1535;
  Gene Symbol: ATP13A4;
  Gene Name: ATPase type 13A4;
  Uniprot ID:  Q4VNC1;
  ENSP ID: ENSP00000383129
MHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 7203 - protein, 576 aa, Homo sapiens
  Payload ID: 1535;
  Gene Symbol: ATP13A4;
  Gene Name: ATPase type 13A4;
  ENSP ID: ENSP00000395367
  MOD_RES (1)..(1): Any amino acid
XGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQRQTAFQITSFCSRIWPLQLLLV

SEQ ID NO: 7204 - protein, 122 aa, Homo sapiens
  Payload ID: 1535;
  Gene Symbol: ATP13A4;
  Gene Name: ATPase type 13A4;
  ENSP ID: ENSP00000401481
  MOD_RES (1)..(1): Any amino acid
XNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLE

SEQ ID NO: 7205 - protein, 83 aa, Homo sapiens
  Payload ID: 1535;
  Gene Symbol: ATP13A4;
  Gene Name: ATPase type 13A4;
  ENSP ID: ENSP00000402023
MGHFEKGQHALLNEGEENEMEIFGYRTQGCRKSLCLAGSIFSFGILPLVFYWRPAWHVWAHCVPCSLQEADTVLLRTTMRSIS

SEQ ID NO: 7206 - protein, 1218 aa, Homo sapiens
  Payload ID: 1536;
  Gene Symbol: ATP13A5;
  Gene Name: ATPase type 13A5;
  Uniprot ID:  Q4VNC0;
  ENSP ID: ENSP00000341942
MEENSKKDHRALLNQGEEDELEVFGYRDHNVRKAFCLVASVLTCGGLLLVFYWRPQWRVWANCIPCPLQEADTVLLRTTDEFQRYMRKKVFCLYLSTLKFPVSKKWEESLVADRHSVINQALIKPELKLRCMEVQKIRYVWNDLEKRFQKVGLLEDSNSCSDIHQTFGLGLTSEEQEVRRLVCGPNAIEVEIQPIWKLLVKQVLNPFYVFQAFTLTLWLSQGYIEYSVAIIILTVISIVLSVYDLRQQSVKLHNLVEDHNKVQVTIIVKDKGLEELESRLLVPGDILILPGKFSLPCDAVLIDGSCVVNEGMLTGESIPVTKTPLPQMENTMPWKCHSLEDYRKHVLFCGTEVIQVKPSGQGPVRAVVLQTGYNTAKGDLVRSILYPRPLNFKLYSDAFKFIVFLACLGVMGFFYALGVYMYHGVPPKDTVTMALILLTVTVPPVLPAALTIGNVYAQKRLKKKKIFCISPQRINMCGQINLVCFDKTGTLTEDGLDLWGTVPTADNCFQEAHSFASGQAVPWSPLCAAMASCHSLILLNGTIQGDPLDLKMFEGTAWKMEDCIVDSCKFGTSVSNIIKPGPKASKSPVEAIITLCQFPFSSSLQRMSVIAQLAGENHFHVYMKGAPEMVARFCRSETVPKNFPQELRSYTVQGFRVIALAHKTLKMGNLSEVEHLAREKVESELTFLGLLIMENRLKKETKLVLKELSEARIRTVMITGDNLQTAITVAKNSEMIPPGSQVIIVEADEPEEFVPASVTWQLVENQETGPGKKEIYMHTGNSSTPRGEGGSCYHFAMSGKSYQVIFQHFNSLLPKILVNGTVFARMSPGQKSSLIEEFQKLNYYVGMCGDGANDCGALKAAHAGISLSEQEASVASPFTSKTTNIQCVPHLIREGRAALVSSFGVFKYLTMYGIIQFISALLLYWQLQLFGNYQYLMQDVAITLMVCLTMSSTHAYPKLAPYRPAGQLLSPPLLLSIFLNSCFSCIVQISAFLYVKQQPWYCEVYQYSECFLANQSNFSTNVSLERNWTGNATLIPGSILSFETTTLWPITTINYITVAFIFSKGKPFRKPIYTNYIFSFLLLAALGLTIFILFSDFQVIYRGMELIPTITSWRVLILVVALTQFCVAFFVEDSILQNHELWLLIKREFGFYSKSQYRTWQKKLAEDSTWPPINRTDYSGDGKNGFYINGGYESHEQIPKRKLKLGGQPTEQHFWARL

SEQ ID NO: 7207 - protein, 158 aa, Homo sapiens
  Payload ID: 1536;
  Gene Symbol: ATP13A5;
  Gene Name: ATPase type 13A5;
  ENSP ID: ENSP00000389416
MEENSKKDHRALLNQGEEDELVESCPGWSEMARSRLTATSASQEVFGYRDHNVRKAFCLVASVLTCGGLLLVFYWRPQWRVWANCIPCPLQEADTVLLRTTDEFQRYMRKKVFCLYLSTLKFPVSKKWEESLVADRHSVINQALIKPELKLRCMEVQK

SEQ ID NO: 7208 - protein, 114 aa, Homo sapiens
  Payload ID: 1536;
  Gene Symbol: ATP13A5;
  Gene Name: ATPase type 13A5;
  ENSP ID: ENSP00000483801
MELIPTITSWRVLILVVALTQFCGFLCRGFHLQNHELWLLIKREFGFYSKSQYRTWQKKLAEDSTWPPINRTDYSGDGKNGFYINGGYESHEQIPKRKLKLGGQPTEQHFWARL

SEQ ID NO: 7209 - protein, 1149 aa, Homo sapiens
  Payload ID: 1537;
  Gene Symbol: ATP8A1;
  Gene Name: ATPase, aminophospholipid transporter (APLT), class I, type 8A, member 1;
  Uniprot ID:  Q9Y2Q0;
  ENSP ID: ENSP00000264449
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVNVGDIVIIKGKEYIPADTVLLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 7210 - protein, 1164 aa, Homo sapiens
  Payload ID: 1537;
  Gene Symbol: ATP8A1;
  Gene Name: ATPase, aminophospholipid transporter (APLT), class I, type 8A, member 1;
  Uniprot ID:  Q9Y2Q0;
  ENSP ID: ENSP00000371084
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 7211 - protein, 142 aa, Homo sapiens
  Payload ID: 1537;
  Gene Symbol: ATP8A1;
  Gene Name: ATPase, aminophospholipid transporter (APLT), class I, type 8A, member 1;
  ENSP ID: ENSP00000421164
  MOD_RES (1)..(1): Any amino acid
XAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVFVRFRCLQQCLL

SEQ ID NO: 7212 - protein, 75 aa, Homo sapiens
  Payload ID: 1537;
  Gene Symbol: ATP8A1;
  Gene Name: ATPase, aminophospholipid transporter (APLT), class I, type 8A, member 1;
  ENSP ID: ENSP00000426495
NLQLLGATAIEDKLQDQVPETIETLMKADIKIWILTGDKQETAINIGHSCKLLKKNMGMIVINEGSLDGFSSSKI

SEQ ID NO: 7213 - protein, 55 aa, Homo sapiens
  Payload ID: 1537;
  Gene Symbol: ATP8A1;
  Gene Name: ATPase, aminophospholipid transporter (APLT), class I, type 8A, member 1;
  ENSP ID: ENSP00000426636
MPTMRRTVSEIRSRAEGYEKTDDVSEKTSLADQEEVRTIFINQPQLTKFCNNHVR

SEQ ID NO: 7214 - protein, 113 aa, Homo sapiens
  Payload ID: 1537;
  Gene Symbol: ATP8A1;
  Gene Name: ATPase, aminophospholipid transporter (APLT), class I, type 8A, member 1;
  ENSP ID: ENSP00000426935
VSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIENTDIQANNNLYSLFT

SEQ ID NO: 7215 - protein, 29 aa, Homo sapiens
  Payload ID: 1537;
  Gene Symbol: ATP8A1;
  Gene Name: ATPase, aminophospholipid transporter (APLT), class I, type 8A, member 1;
  ENSP ID: ENSP00000427295
KRHKADNAVNKKQTQVLRNGAWEIVHWEK

SEQ ID NO: 7216 - protein, 994 aa, Homo sapiens [sequence omitted]

SEQ ID NO: 7217 - protein, 643 aa, Homo sapiens
  Payload ID: 1538;
  Gene Symbol: ATP8A2;
  Gene Name: ATPase, aminophospholipid transporter, class I, type 8A, member 2;
  ENSP ID: ENSP00000281620
MWHTIMWKEVAVGDIVKVVNGQYLPADVVLLSSSEPQAMCYVETANLDGETNLKIRQGLSHTADMQTREVLMKLSGTIECEGPNRHLYDFTGNLNLDGKSLVALGPDQILLRGTQLRNTQWVFGIVVYTGHDTKLMQNSTKAPLKRSNVEKVTNVQILVLFGILLVMALVSSAGALYWNRSHGEKNWYIKKMDTTSDNFGYNLLTFIILYNNLIPISLLVTLEVVKYTQALFINWDTDMYYIGNDTPAMARTSNLNEELGQVKYLFSDKTGTLTCNIMNFKKCSIAGVTYGHFPELAREPSSDDFCRMPPPCSDSCDFDDPRLLKNIEDRHPTAPCIQEFLTLLAVCHTVVPEKDGDNIIYQASSPDEAALVKGAKKLGFVFTARTPFSVIIEAMGQEQTFGILNVLEFSSDRKRMSVIVRTPSGRLRLYCKGADNVIFERLSKDSKYMEETLCHLEYFATEGLRTLCVAYADLSENEYEEWLKVYQEASTILKDRAQRLEECYEIIEKNLLLLGATAIEDRLQAGVPETIATLLKAEIKIWVLTGDKQETAINIGYSCRLVSQNMALILLKEDSLDATRAAITQHCTDLGNLLGKENDVALIIDGHTLKYALSFEVRRSFLDLALSCKAVICCRSLFLSKWR

SEQ ID NO: 7218 - protein, 1188 aa, Homo sapiens
  Payload ID: 1538;
  Gene Symbol: ATP8A2;
  Gene Name: ATPase, aminophospholipid transporter, class I, type 8A, member 2;
  Uniprot ID:  Q9NTI2;
  ENSP ID: ENSP00000371070
MLNGAGLDKALKMSLPRRSRIRSSVGPVRSSLGYKKAEDEMSRATSVGDQLEAPARTIYLNQPHLNKFRDNQISTAKYSVLTFLPRFLYEQIRRAANAFFLFIALLQQIPDVSPTGRYTTLVPLIIILTIAGIKEIVEDFKRHKADNAVNKKKTIVLRNGMWHTIMWKEVAVGDIVKVVNGQYLPADVVLLSSSEPQAMCYVETANLDGETNLKIRQGLSHTADMQTREVLMKLSGTIECEGPNRHLYDFTGNLNLDGKSLVALGPDQILLRGTQLRNTQWVFGIVVYTGHDTKLMQNSTKAPLKRSNVEKVTNVQILVLFGILLVMALVSSAGALYWNRSHGEKNWYIKKMDTTSDNFGYNLLTFIILYNNLIPISLLVTLEVVKYTQALFINWDTDMYYIGNDTPAMARTSNLNEELGQVKYLFSDKTGTLTCNIMNFKKCSIAGVTYGHFPELAREPSSDDFCRMPPPCSDSCDFDDPRLLKNIEDRHPTAPCIQEFLTLLAVCHTVVPEKDGDNIIYQASSPDEAALVKGAKKLGFVFTARTPFSVIIEAMGQEQTFGILNVLEFSSDRKRMSVIVRTPSGRLRLYCKGADNVIFERLSKDSKYMEETLCHLEYFATEGLRTLCVAYADLSENEYEEWLKVYQEASTILKDRAQRLEECYEIIEKNLLLLGATAIEDRLQAGVPETIATLLKAEIKIWVLTGDKQETAINIGYSCRLVSQNMALILLKEDSLDATRAAITQHCTDLGNLLGKENDVALIIDGHTLKYALSFEVRRSFLDLALSCKAVICCRVSPLQKSEIVDVVKKRVKAITLAIGDGANDVGMIQTAHVGVGISGNEGMQATNNSDYAIAQFSYLEKLLLVHGAWSYNRVTKCILYCFYKNVVLYIIELWFAFVNGFSGQILFERWCIGLYNVIFTALPPFTLGIFERSCTQESMLRFPQLYKITQNGEGFNTKVFWGHCINALVHSLILFWFPMKALEHDTVLTSGHATDYLFVGNIVYTYVVVTVCLKAGLETTAWTKFSHLAVWGSMLTWLVFFGIYSTIWPTIPIAPDMRGQATMVLSSAHFWLGLFLVPTACLIEDVAWRAAKHTCKKTLLEEVQELETKSRVLGKAVLRDSNGKRLNERDRLIKRLGRKTPPTLFRGSSLQQGVPHGYAFSQEEHGAVSQEEVIRAYDTTKKKSRKK

SEQ ID NO: 7219 - protein, 1251 aa, Homo sapiens
  Payload ID: 1539;
  Gene Symbol: ATP8B1;
  Gene Name: ATPase, aminophospholipid transporter, class I, type 8B, member 1;
  Uniprot ID:  O43520;
  ENSP ID: ENSP00000283684
MSTERDSETTFDEDSQPNDEVVPYSDDETEDELDDQGSAVEPEQNRVNREAEENREPFRKECTWQVKANDRKYHEQPHFMNTKFLCIKESKYANNAIKTYKYNAFTFIPMNLFEQFKRAANLYFLALLILQAVPQISTLAWYTTLVPLLVVLGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEIEEKEFTEWNKKFMAASVASTNRDEALDKVYEEIEKDLILLGATAIEDKLQDGVPETISKLAKADIKIWVLTGDKKETAENIGFACELLTEDTTICYGEDINSLLHARMENQRNRGGVYAKFAPPVQESFFPPGGNRALIITGSWLNEILLEKKTKRNKILKLKFPRTEEERRMRTQSKRRLEAKKEQRQKNFVDLACECSAVICCRVTPKQKAMVVDLVKRYKKAITLAIGDGANDVNMIKTAHIGVGISGQEGMQAVMSSDYSFAQFRYLQRLLLVHGRWSYIRMCKFLRYFFYKNFAFTLVHFWYSFFNGYSAQTAYEDWFITLYNVLYTSLPVLLMGLLDQDVSDKLSLRFPGLYIVGQRDLLFNYKRFFVSLLHGVLTSMILFFIPLGAYLQTVGQDGEAPSDYQSFAVTIASALVITVNFQIGLDTSYWTFVNAFSIFGSIALYFGIMFDFHSAGIHVLFPSAFQFTGTASNALRQPYIWLTIILAVAVCLLPVVAIRFLSMTIWPSESDKIQKHRKRLKAEEQWQRRQQVFRRGVSTRRSAYAFSHQRGYADLISSGRSIRKKRSPLDAIVADGTAEYRRTGDS

SEQ ID NO: 7220 - protein, 1251 aa, Homo sapiens; identical to SEQ ID NO: 7219
  Payload ID: 1539;
  Gene Symbol: ATP8B1;
  Gene Name: ATPase, aminophospholipid transporter, class I, type 8B, member 1;
  Uniprot ID:  O43520;
  ENSP ID: ENSP00000445359

SEQ ID NO: 7221 - protein, 61 aa, Homo sapiens
  Payload ID: 1539;
  Gene Symbol: ATP8B1;
  Gene Name: ATPase, aminophospholipid transporter, class I, type 8B, member 1;
  ENSP ID: ENSP00000467767
MSTERDSETTFDEDSQPNDEVVPYSDDETEDELDDQGSAVEPEQNRVNREAEENREPFRKE

SEQ ID NO: 7222 - protein, 92 aa, Homo sapiens
  Payload ID: 1539;
  Gene Symbol: ATP8B1;
  Gene Name: ATPase, aminophospholipid transporter, class I, type 8B, member 1;
  ENSP ID: ENSP00000468266
MYYAEKDTPAKARTTTLNEQLGQIHYIFSDKTGTLTQNIMTFKKCCINGQIYGDHRDASQHNHNKIEQVDFSWNTYADGKLAFYDHYLIEQI

SEQ ID NO: 7223 - protein, 11 aa, Homo sapiens
  Payload ID: 1539;
  Gene Symbol: ATP8B1;
  Gene Name: ATPase, aminophospholipid transporter, class I, type 8B, member 1;
  ENSP ID: ENSP00000468751
MSTERDSETTF

SEQ ID NO: 7224 - protein, 387 aa, Homo sapiens
  Payload ID: 1540;
  Gene Symbol: ATP8B2;
  Gene Name: ATPase, aminophospholipid transporter, class I, type 8B, member 2;
  Uniprot ID:  P98198;
  ENSP ID: ENSP00000357472
MAVCAKKRPPEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVRYVPSLTWGLSRESGGPIELFFSMKMKSLRSNEKSSSSCTVNI

SEQ ID NO: 7225 - protein, 1223 aa, Homo sapiens
  Payload ID: 1540;
  Gene Symbol: ATP8B2;
  Gene Name: ATPase, aminophospholipid transporter, class I, type 8B, member 2;
  Uniprot ID:  P98198;
  ENSP ID: ENSP00000357475
MDTLRAVPLFSISGLFSFPYRVSHGIAGILLGEMAVCAKKRPPEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSVEVIRLGHSYFINWDKKMFCMKKRTPAEARTTTLNEELGQVEYIFSDKTGTLTQNIMVFNKCSINGHSYGDVFDVLGHKAELGERPEPVDFSFNPLADKKFLFWDPSLLEAVKIGDPHTHEFFRLLSLCHTVMSEEKNEGELYYKAQSPDEGALVTAARNFGFVFRSRTPKTITVHEMGTAITYQLLAILDFNNIRKRMSVIVRNPEGKIRLYCKGADTILLDRLHHSTQELLNTTMDHLNEYAGEGLRTLVLAYKDLDEEYYEEWAERRLQASLAQDSREDRLASIYEEVENNMMLLGATAIEDKLQQGVPETIALLTLANIKIWVLTGDKQETAVNIGYSCKMLTDDMTEVFIVTGHTVLEVREELRKAREKMMDSSRSVGNGFTYQDKLSSSKLTSVLEAVAGEYALVINGHSLAHALEADMELEFLETACACKAVICCRVTPLQKAQVVELVKKYKKAVTLAIGDGANDVSMIKTAHIGVGISGQEGIQAVLASDYSFSQFKFLQRLLLVHGRWSYLRMCKFLCYFFYKNFAFTMVHFWFGFFCGFSAQTVYDQYFITLYNIVYTSLPVLAMGVFDQDVPEQRSMEYPKLYEPGQLNLLFNKREFFICIAQGIYTSVLMFFIPYGVFADATRDDGTQLADYQSFAVTVATSLVIVVSVQIGLDTGYWTAINHFFIWGSLAVYFAILFAMHSNGLFDMFPNQFRFVGNAQNTLAQPTVWLTIVLTTVVCIMPVVAFRFLRLNLKPDLSDTVRYTQLVRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 7226 - protein, 1300 aa, Homo sapiens
  Payload ID: 1541;
  Gene Symbol: ATP8B3;
  Gene Name: ATPase, aminophospholipid transporter, class I, type 8B, member 3;
  Uniprot ID:  O60423;
  ENSP ID: ENSP00000311336
MGTGPAQTPRSTRAGPEPSPAPPGPGDTGDSDVTQEGSGPAGIRGGETVIRAGMGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYAGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGPDSEATTRPKENPYLWNKFADGKLLFHNAALLHLVRTNGDEAVREFWRLLAICHTVMVRESPRERPDQLLYQAASPDEGALVTAARNFGYVFLSRTQDTVTIMELGEERVYQVLAIMDFNSTRKRMSVLVRKPEGAICLYTKGADTVIFERLHRRGAMEFATEEALAAFAQETLRTLCLAYREVAEDIYEDWQQRHQEASLLLQNRAQALQQLLGATAIEDRLQDGVPETIKCLKKSNIKIWVLTGDKQETAVNIGFACELLSENMLILEEKEISRILETYWENSNNLLTRESLSQVKLALVINGDFLDKLLVSLRKEPRALAQNVNMDEAWQELGQSRRDFLYARRLSLLCRRFGLPLAAPPAQDSRARRSSEVLQERAFVDLASKCQAVICCRVTPKQKALIVALVKKYHQVVTLAIGDGANDINMIKTADVGVGLAGQEGMQAVQNSDFVLGQFCFLQRLLLVHGRWSYVRICKFLRYFFYKSMASMMVQVWFACYNGFTGQPLYEGWFLALFNLLYSTLPVLYIGLFEQDVSAEQSLEKPELYVVGQKDELFNYWVFVQAIAHGVTTSLVNFFMTLWISRDTAGPASFSDHQSFAVVVALSCLLSITMEVILIIKYWTALCVATILLSLGFYAIMTTTTQSFWLFRVSPTTFPFLYADLSVMSSPSILLVVLLSVSINTFPVLALRVIFPALKELRAKEEKVEEGPSEEIFTMEPLPHVHRESRARRSSYAFSHREGYANLITQGTILRRGPGVSSDIASESLDPSDEEAASSPKESQ

SEQ ID NO: 7227 - protein, 1263 aa, Homo sapiens
  Payload ID: 1541;
  Gene Symbol: ATP8B3;
  Gene Name: ATPase, aminophospholipid transporter, class I, type 8B, member 3;
  Uniprot ID:  O60423;
  ENSP ID: ENSP00000437115
MGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYADGYMFVGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGPDSEATTRPKENPYLWNKFADGKLLFHNAALLHLVRTNGDEAVREFWRLLAICHTVMVRESPRERPDQLLYQAASPDEGALVTAARNFGYVFLSRTQDTVTIMELGEERVYQVLAIMDFNSTRKRMSVLVRKPEGAICLYTKGADTVIFERLHRRGAMEFATEEALAAFAQETLRTLCLAYREVAEDIYEDWQQRHQEASLLLQNRAQALQQVYNEMEQDLRLLGATAIEDRLQDGVPETIKCLKKSNIKIWVLTGDKQETAVNIGFACELLSENMLILEEKEISRILETYWENSNNLLTRESLSQVKLALVINGDFLDKLLVSLRKEPRALAQNVNMDEAWQELGQSRRDFLYARRLSLLCRRFGLPLAAPPAQDSRARRSSEVLQERAFVDLASKCQAVICCRVTPKQKALIVALVKKYHQVVTLAIGDGANDINMIKTADVGVGLAGQEGMQAVQNSDFVLGQFCFLQRLLLVHGRWSYVRICKFLRYFFYKSMASMMVQVWFACYNGFTGQPLYEGWFLALFNLLYSTLPVLYIGLFEQDVSAEQSLEKPELYVVGQKDELFNYWVFVQAIAHGVTTSLVNFFMTLWISRDTAGPASFSDHQSFAVVVALSCLLSITMEVILIIKYWTALCVATILLSLGFYAIMTTTTQSFWLFRVSPTTFPFLYADLSVMSSPSILLVVLLSVSINTFPVLALRVIFPALKELRAKEEKVEEGPSEEIFTMEPLPHVHRESRARRSSYAFSHREGYANLITQGTILRRGPGVSSDIASESLDPSDEEAASSPKESQ

SEQ ID NO: 7228 - protein, 38 aa, Homo sapiens
  Payload ID: 1541;
  Gene Symbol: ATP8B3;
  Gene Name: ATPase, aminophospholipid transporter, class I, type 8B, member 3;
  ENSP ID: ENSP00000439993
  MOD_RES (1)..(1): Any amino acid
XGFACELLSENMLILEEKEIRTNCWCPCGRSRAPWRRT

SEQ ID NO: 7229 - protein, 86 aa, Homo sapiens
  Payload ID: 1541;
  Gene Symbol: ATP8B3;
  Gene Name: ATPase, aminophospholipid transporter, class I, type 8B, member 3;
  ENSP ID: ENSP00000444334
MGTGPAQTPRSTRAGPEPSPAPPGPGDTGDSDVTQEGSGPAGIRGAPPAWAASAREKISKMRTGTQHSPGRSRPTTVPTTGSSRRR

SEQ ID NO: 7230 - protein, 562 aa, Homo sapiens
  Payload ID: 1541;
  Gene Symbol: ATP8B3;
  Gene Name: ATPase, aminophospholipid transporter, class I, type 8B, member 3;
  ENSP ID: ENSP00000445204
MGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYAGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGAAPTPELPAGSSIFKGLRVPENQSHVWPHAQHLRPNLNQGTVARWPGFLWRGPGKFFFFFEAESHSVYPGRNAVVQSWLTAISTSQVQAILLAQPPE

SEQ ID NO: 7231 - protein, 205 aa, Homo sapiens
  Payload ID: 1541;
  Gene Symbol: ATP8B3;
  Gene Name: ATPase, aminophospholipid transporter, class I, type 8B, member 3;
  ENSP ID: ENSP00000465027
MGTGPAQTPRSTRAGPEPSPAPPGPGDTGDSDVTQEGSGPAGIRGGETVIRAGMGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDM

SEQ ID NO: 7232 - protein, 1001 aa, Homo sapiens
  Payload ID: 1542;
  Gene Symbol: ATP2A1;
  Gene Name: ATPase, Ca++ transporting, cardiac muscle, fast twitch 1;
  Uniprot ID:  O14983;
  ENSP ID: ENSP00000349595
MEAAHAKTTEECLAYFGVSETTGLTPDQVKRNLEKYGLNELPAEEGKTLWELVIEQFEDLLVRILLLAACISFVLAWFEEGEETITAFVEPFVILLILIANAIVGVWQERNAENAIEALKEYEPEMGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEDPEDERRK

SEQ ID NO: 7233 - protein, 994 aa, Homo sapiens
  Payload ID: 1542;
  Gene Symbol: ATP2A1;
  Gene Name: ATPase, Ca++ transporting, cardiac muscle, fast twitch 1;
  Uniprot ID:  O14983;
  ENSP ID: ENSP00000378879
MEAAHAKTTEECLAYFGVSETTGLTPDQVKRNLEKYGLNELPAEEGKTLWELVIEQFEDLLVRILLLAACISFVLAWFEEGEETITAFVEPFVILLILIANAIVGVWQERNAENAIEALKEYEPEMGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEG

SEQ ID NO: 7234 - protein, 869 aa, Homo sapiens
  Payload ID: 1542;
  Gene Symbol: ATP2A1;
  Gene Name: ATPase, Ca++ transporting, cardiac muscle, fast twitch 1;
  Uniprot ID:  O14983;
  ENSP ID: ENSP00000443101
MGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEG

SEQ ID NO: 7235 - protein, 41 aa, Homo sapiens
  Payload ID: 1542;
  Gene Symbol: ATP2A1;
  Gene Name: ATPase, Ca++ transporting, cardiac muscle, fast twitch 1;
  ENSP ID: ENSP00000457148
VICSDKTGTLTTNQMSVCKGLPLTSGQEPLPFTEFCGRLHP

SEQ ID NO: 7236 - protein, 128 aa, Homo sapiens
  Payload ID: 1542;
  Gene Symbol: ATP2A1;
  Gene Name: ATPase, Ca++ transporting, cardiac muscle, fast twitch 1;
  ENSP ID: ENSP00000457357
  MOD_RES (1)..(1): Any amino acid
XGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVPKVSMRRSARPPRQHSPPWWRR

SEQ ID NO: 7237 - protein, 24 aa, Homo sapiens
  Payload ID: 1542;
  Gene Symbol: ATP2A1;
  Gene Name: ATPase, Ca++ transporting, cardiac muscle, fast twitch 1;
  ENSP ID: ENSP00000457793
  MOD_RES (1)..(1): Any amino acid
XKISLPVIGLDEILKFVARNYLEG

SEQ ID NO: 7238 - protein, 26 aa, Homo sapiens
  Payload ID: 1542;
  Gene Symbol: ATP2A1;
  Gene Name: ATPase, Ca++ transporting, cardiac muscle, fast twitch 1;
  ENSP ID: ENSP00000457798
MGKVYRADRKSVQRIKARDIVPGDIV

SEQ ID NO: 7239 - protein, 113 aa, Homo sapiens
  Payload ID: 1542;
  Gene Symbol: ATP2A1;
  Gene Name: ATPase, Ca++ transporting, cardiac muscle, fast twitch 1;
  ENSP ID: ENSP00000458035
MNLSFSSFSWVELPAEEGKTLWELVIEQFEDLLVRILLLAACISFVLAWFEEGEETITAFVEPFVILLILIANAIVGVWQERNAENAIEALKEYEPEMGKVYRADRKSVQRIK

SEQ ID NO: 7240 - protein, 997 aa, Homo sapiens
  Payload ID: 1543;
  Gene Symbol: ATP2A2;
  Gene Name: ATPase, Ca++ transporting, cardiac muscle, slow twitch 2;
  Uniprot ID:  P16615;
  ENSP ID: ENSP00000311186
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAILE

SEQ ID NO: 7241 - protein, 50 aa, Homo sapiens
  Payload ID: 1543;
  Gene Symbol: ATP2A2;
  Gene Name: ATPase, Ca++ transporting, cardiac muscle, slow twitch 2;
  ENSP ID: ENSP00000366913
MENAHTKTVEEVLGHFGVNESTGLSLEQVKKLKERWGSNGRCREKPCWNL

SEQ ID NO: 7242 - protein, 1042 aa, Homo sapiens
  Payload ID: 1543;
  Gene Symbol: ATP2A2;
  Gene Name: ATPase, Ca++ transporting, cardiac muscle, slow twitch 2;
  Uniprot ID:  P16615;
  ENSP ID: ENSP00000440045
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 7243 - protein, 44 aa, Homo sapiens
  Payload ID: 1543;
  Gene Symbol: ATP2A2;
  Gene Name: ATPase, Ca++ transporting, cardiac muscle, slow twitch 2;
  ENSP ID: ENSP00000447406
MQLWVYGRKEMLKMPSKPLRNMSLKWAKCIDRTERVCSGLKLKT

SEQ ID NO: 7244 - protein, 933 aa, Homo sapiens
  Payload ID: 1543;
  Gene Symbol: ATP2A2;
  Gene Name: ATPase, Ca++ transporting, cardiac muscle, slow twitch 2;
  ENSP ID: ENSP00000449454
  MOD_RES (1)..(1): Any amino acid
XTITAFVEPFVILLILVANAIVGVWQERNAENAIEALKEYEPEMGKVYRQDRKSVQRIKAKDIVPGDIVEIAGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 7245 - protein, 46 aa, Homo sapiens
  Payload ID: 1543;
  Gene Symbol: ATP2A2;
  Gene Name: ATPase, Ca++ transporting, cardiac muscle, slow twitch 2;
  ENSP ID: ENSP00000450407
LIFQITPLNVTQWLMVLKISLPVILMDETLKFVARNYLEPVLSSEL

SEQ ID NO: 7246 - protein, 1220 aa, Homo sapiens
  Payload ID: 1544;
  Gene Symbol: ATP2B1;
  Gene Name: ATPase, Ca++ transporting, plasma membrane 1;
  Uniprot ID:  P20020;
  ENSP ID: ENSP00000261173
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 7247 - protein, 1176 aa, Homo sapiens
  Payload ID: 1544;
  Gene Symbol: ATP2B1;
  Gene Name: ATPase, Ca++ transporting, plasma membrane 1;
  Uniprot ID:  P20020;
  ENSP ID: ENSP00000352054
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQMDVVNAFQSGSSIQGALRRQPSIASQHHDVTNISTPTHVVFSSSTASTTVGYSSGECIS

SEQ ID NO: 7248 - protein, 963 aa, Homo sapiens [sequence omitted]

SEQ ID NO: 7249 - protein, 1220 aa, Homo sapiens; identical to SEQ ID NO: 7246
  Payload ID: 1544;
  Gene Symbol: ATP2B1;
  Gene Name: ATPase, Ca++ transporting, plasma membrane 1;
  Uniprot ID:  P20020;
  ENSP ID: ENSP00000392043

SEQ ID NO: 7250 - protein, 101 aa, Homo sapiens
  Payload ID: 1544;
  Gene Symbol: ATP2B1;
  Gene Name: ATPase, Ca++ transporting, plasma membrane 1;
  ENSP ID: ENSP00000447041
MGDMANNSVAYSGVKNSLKEANHDGDFGITLAELRALMELRSTDALRKIQESYGDVYGICTKLKTSPNEGEFYYACFWFFVQRVLYIWLINEHAYIILAIV

SEQ ID NO: 7251 - protein, 162 aa, Homo sapiens
  Payload ID: 1544;
  Gene Symbol: ATP2B1;
  Gene Name: ATPase, Ca++ transporting, plasma membrane 1;
  ENSP ID: ENSP00000447096
  MOD_RES (1)..(1): Any amino acid
XFNEINARKIHGERNVFEGIFNNAIFCTIVLGTFVVQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPP

SEQ ID NO: 7252 - protein, 300 aa, Homo sapiens
  Payload ID: 1544;
  Gene Symbol: ATP2B1;
  Gene Name: ATPase, Ca++ transporting, plasma membrane 1;
  ENSP ID: ENSP00000489171
  MOD_RES (1)..(1): Any amino acid
XEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQMDVVNAFQSGSSIQGALRRQPSIASQHHDIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 7253 - protein, 1243 aa, Homo sapiens [sequence omitted]

SEQ ID NO: 7254 - protein, 1243 aa, Homo sapiens [sequence omitted]

SEQ ID NO: 7255 - protein, 1198 aa, Homo sapiens
  Payload ID: 1545;
  Gene Symbol: ATP2B2;
  Gene Name: ATPase, Ca++ transporting, plasma membrane 2;
  Uniprot ID:  Q01814;
  ENSP ID: ENSP00000373311
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 7256 - protein, 1198 aa, Homo sapiens; identical to SEQ ID NO: 7255
  Payload ID: 1545;
  Gene Symbol: ATP2B2;
  Gene Name: ATPase, Ca++ transporting, plasma membrane 2;
  Uniprot ID:  Q01814;
  ENSP ID: ENSP00000380267

SEQ ID NO: 7257 - protein, 1099 aa, Homo sapiens
  Payload ID: 1545;
  Gene Symbol: ATP2B2;
  Gene Name: ATPase, Ca++ transporting, plasma membrane 2;
  ENSP ID: ENSP00000414854
AAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKGKMQDGNVDASQSKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 7258 - protein, 1154 aa, Homo sapiens
  Payload ID: 1545;
  Gene Symbol: ATP2B2;
  Gene Name: ATPase, Ca++ transporting, plasma membrane 2;
  Uniprot ID:  Q01814;
  ENSP ID: ENSP00000424494
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIEVVNTFKSGASFQGALRRQSSVTSQSQDVANLSSPSRVSLSNALSSPTSLPPAAAGQG

SEQ ID NO: 7259 - protein, 1220 aa, Homo sapiens
  Payload ID: 1546;
  Gene Symbol: ATP2B3;
  Gene Name: ATPase, Ca++ transporting, plasma membrane 3;
  Uniprot ID:  Q16720;
  ENSP ID: ENSP00000263519
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 7260 - protein, 1220 aa, Homo sapiens; identical to SEQ ID NO: 7259
  Payload ID: 1546;
  Gene Symbol: ATP2B3;
  Gene Name: ATPase, Ca++ transporting, plasma membrane 3;
  Uniprot ID:  Q16720;
  ENSP ID: ENSP00000343886

SEQ ID NO: 7261 - protein, 1173 aa, Homo sapiens
  Payload ID: 1546;
  Gene Symbol: ATP2B3;
  Gene Name: ATPase, Ca++ transporting, plasma membrane 3;
  Uniprot ID:  Q16720;
  ENSP ID: ENSP00000352062
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 7262 - protein, 1159 aa, Homo sapiens
  Payload ID: 1546;
  Gene Symbol: ATP2B3;
  Gene Name: ATPase, Ca++ transporting, plasma membrane 3;
  Uniprot ID:  Q16720;
  ENSP ID: ENSP00000359205
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 7263 - protein, 1154 aa, Homo sapiens
  Payload ID: 1546;
  Gene Symbol: ATP2B3;
  Gene Name: ATPase, Ca++ transporting, plasma membrane 3;
  Uniprot ID:  Q16720;
  ENSP ID: ENSP00000377425
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGSES

SEQ ID NO: 7264 - protein, 1170 aa, Homo sapiens
  Payload ID: 1547;
  Gene Symbol: ATP2B4;
  Gene Name: ATPase, Ca++ transporting, plasma membrane 4;
  Uniprot ID:  P23634;
  ENSP ID: ENSP00000340930
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 7265 - protein, 129 aa, Homo sapiens
  Payload ID: 1547;
  Gene Symbol: ATP2B4;
  Gene Name: ATPase, Ca++ transporting, plasma membrane 4;
  ENSP ID: ENSP00000349165
  MOD_RES (1)..(1): Any amino acid
XIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGSE

SEQ ID NO: 7266 - protein, 1205 aa, Homo sapiens
  Payload ID: 1547;
  Gene Symbol: ATP2B4;
  Gene Name: ATPase, Ca++ transporting, plasma membrane 4;
  Uniprot ID:  P23634;
  ENSP ID: ENSP00000350310
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 7267 - protein, 1170 aa, Homo sapiens; identical to SEQ ID NO: 7264
  Payload ID: 1547;
  Gene Symbol: ATP2B4;
  Gene Name: ATPase, Ca++ transporting, plasma membrane 4;
  Uniprot ID:  P23634;
  ENSP ID: ENSP00000356187

SEQ ID NO: 7268 - protein, 117 aa, Homo sapiens
  Payload ID: 1547;
  Gene Symbol: ATP2B4;
  Gene Name: ATPase, Ca++ transporting, plasma membrane 4;
  ENSP ID: ENSP00000391150
  MOD_RES (1)..(1): Any amino acid
XGGKPFSCTSLSLSQWLWCLFIGIGELLWGQFISAIPTRSLKFLKEAGHGTTKEEITKDAEGLDEIDHAEMELRRGQILWFRGLNRIQTQHLLQDSDLLPDKEEAIISSSLFPSCNF

SEQ ID NO: 7269 - protein, 102 aa, Homo sapiens
  Payload ID: 1547;
  Gene Symbol: ATP2B4;
  Gene Name: ATPase, Ca++ transporting, plasma membrane 4;
  ENSP ID: ENSP00000433577
  MOD_RES (1)..(1): Any amino acid
XTKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 7270 - protein, 888 aa, Homo sapiens
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000329664
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILGLALGEEWTAAG

SEQ ID NO: 7271 - protein, 949 aa, Homo sapiens
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000352665
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVWLWERSGQQLVEIHPHLETGLPLTEDVSCV

SEQ ID NO: 7272 - protein, 919 aa, Homo sapiens
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000395809
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 7273 - protein, 939 aa, Homo sapiens
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000402677
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 7274 - protein, 82 aa, Homo sapiens
  Payload ID: 1548;
  Gene Symbol: ATP2C1;
  Gene Name: ATPase, Ca++ transporting, type 2C, member 1;
  ENSP ID: ENSP00000421261
MIPVLTSKKASELPVSEVASILQADLQNGLNKCEVSHRRAFHGWNEFDISEDEPLWKKYISQFKNPLIMLLLASAVISVLMH

SEQ ID NO: 7275 - protein, 973 aa, Homo sapiens
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000421326
MDSLLPPSRFSYFKKYPLHAIRRYLSTLRNQRAEEQVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 7276 - protein, 215 aa, Homo sapiens
  Payload ID: 1548;
  Gene Symbol: ATP2C1;
  Gene Name: ATPase, Ca++ transporting, type 2C, member 1;
  ENSP ID: ENSP00000422489
VTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVYLVF

SEQ ID NO: 7277 - protein, 923 aa, Homo sapiens
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000422872
MIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 7278 - protein, 131 aa, Homo sapiens
  Payload ID: 1548;
  Gene Symbol: ATP2C1;
  Gene Name: ATPase, Ca++ transporting, type 2C, member 1;
  ENSP ID: ENSP00000422890
MDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDV

SEQ ID NO: 7279 - protein, 903 aa, Homo sapiens
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000423330
MIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 7280 - protein, 953 aa, Homo sapiens
  Payload ID: 1548;
  Gene Symbol: ATP2C1;
  Gene Name: ATPase, Ca++ transporting, type 2C, member 1;
  ENSP ID: ENSP00000423774
MDSLLPPSRFSYFKKYPLHAIRRYLSTLRNQRAEEQVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 7281 - protein, 919 aa, Homo sapiens; identical to SEQ ID NO: 7272
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000424783

SEQ ID NO: 7282 - protein, 314 aa, Homo sapiens
  Payload ID: 1548;
  Gene Symbol: ATP2C1;
  Gene Name: ATPase, Ca++ transporting, type 2C, member 1;
  ENSP ID: ENSP00000424930
  MOD_RES (1)..(1): Any amino acid
XEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWR

SEQ ID NO: 7283 - protein, 903 aa, Homo sapiens
  Payload ID: 1548;
  Gene Symbol: ATP2C1;
  Gene Name: ATPase, Ca++ transporting, type 2C, member 1;
  ENSP ID: ENSP00000425228
  MOD_RES (1)..(1): Any amino acid
XKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVWLWERSGQQLVEIHPHLETGLPLTEDVSCV

SEQ ID NO: 7284 - protein, 944 aa, Homo sapiens
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000425320
MDSLLPPSRFSYFKKYPLHAIRRYLSTLRNQRAEEQVARFQKIPNGENETMIPVLTSKKASELPVSEVASILQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEVWLWERSGQQLVEIHPHLETGLPLTEDVSCV

SEQ ID NO: 7285 - protein, 102 aa, Homo sapiens
  Payload ID: 1548;
  Gene Symbol: ATP2C1;
  Gene Name: ATPase, Ca++ transporting, type 2C, member 1;
  ENSP ID: ENSP00000426849
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDD

SEQ ID NO: 7286 - protein, 50 aa, Homo sapiens
  Payload ID: 1548;
  Gene Symbol: ATP2C1;
  Gene Name: ATPase, Ca++ transporting, type 2C, member 1;
  ENSP ID: ENSP00000427087
LVDDDFQTIMSAIEEGKGIYNNIKNFVRFQLSTFCGSILLWMDPQLRALE

SEQ ID NO: 7287 - protein, 919 aa, Homo sapiens; identical to SEQ ID NO: 7272
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000427461

SEQ ID NO: 7288 - protein, 120 aa, Homo sapiens
  Payload ID: 1548;
  Gene Symbol: ATP2C1;
  Gene Name: ATPase, Ca++ transporting, type 2C, member 1;
  ENSP ID: ENSP00000427625
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQ

SEQ ID NO: 7289 - protein, 888 aa, Homo sapiens; identical to SEQ ID NO: 7270
  Payload ID: 1548;
  Gene Symbol: ATP2C1;
  Gene Name: ATPase, Ca++ transporting, type 2C, member 1;
  Uniprot ID:  P98194;
  ENSP ID: ENSP00000432956

SEQ ID NO: 7290 - protein, 946 aa, Homo sapiens
  Payload ID: 1549;
  Gene Symbol: ATP2C2;
  Gene Name: ATPase, Ca++ transporting, type 2C, member 2;
  Uniprot ID:  O75185;
  ENSP ID: ENSP00000262429
MVEGRVSEFLKKLGFSGGGRQYQALEKDEEEALIDEQSELKAIEKEKKVTALPPKEACKCQKEDLARAFCVDLHTGLSEFSVTQRRLAHGWNEFVADNSEPVWKKYLDQFKNPLILLLLGSALVSVLTKEYEDAVSIATAVLVVVTVAFIQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 7291 - protein, 975 aa, Homo sapiens
  Payload ID: 1549;
  Gene Symbol: ATP2C2;
  Gene Name: ATPase, Ca++ transporting, type 2C, member 2;
  ENSP ID: ENSP00000397925
MVEGRVSEFLKKLGFSGGGRQYQALEKDEEEALIDEQSELKAIEKEKKVTALPPKEACKCQKEDLARAFCVDLHTGLSEFSVTQRRLAHGWNEFVADNSEPVWKKYLDQFKNPLILLLLGSALVSVLTKEYEDAVSIATAVLVVVTVAFIQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQRSSQKTEVCCTAVRLGVEGRGESTWAGRAGLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 7292 - protein, 53 aa, Homo sapiens
  Payload ID: 1549;
  Gene Symbol: ATP2C2;
  Gene Name: ATPase, Ca++ transporting, type 2C, member 2;
  ENSP ID: ENSP00000456595
  MOD_RES (1)..(1): Any amino acid
XVWKKYLDQFKNPLILLLLGSALVSVLTKEYEDAVSIATAVLVVVTVAFIQHI

SEQ ID NO: 7293 - protein, 1043 aa, Homo sapiens
  Payload ID: 1550;
  Gene Symbol: ATP2A3;
  Gene Name: ATPase, Ca++ transporting, ubiquitous;
  Uniprot ID:  Q93084;
  ENSP ID: ENSP00000301387
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGRNEPEVSAGNRVESPVCTSD

SEQ ID NO: 7294 - protein, 1029 aa, Homo sapiens
  Payload ID: 1550;
  Gene Symbol: ATP2A3;
  Gene Name: ATPase, Ca++ transporting, ubiquitous;
  Uniprot ID:  Q93084;
  ENSP ID: ENSP00000312577
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGLASLKK

SEQ ID NO: 7295 - protein, 1052 aa, Homo sapiens
  Payload ID: 1550;
  Gene Symbol: ATP2A3;
  Gene Name: ATPase, Ca++ transporting, ubiquitous;
  Uniprot ID:  Q93084;
  ENSP ID: ENSP00000353072
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGLASLGQGHSIVSLSELLREGGSREEMSQK

SEQ ID NO: 7296 - protein, 1029 aa, Homo sapiens; identical to SEQ ID NO: 7294
  Payload ID: 1550;
  Gene Symbol: ATP2A3;
  Gene Name: ATPase, Ca++ transporting, ubiquitous;
  Uniprot ID:  Q93084;
  ENSP ID: ENSP00000380229

SEQ ID NO: 7297 - protein, 999 aa, Homo sapiens
  Payload ID: 1550;
  Gene Symbol: ATP2A3;
  Gene Name: ATPase, Ca++ transporting, ubiquitous;
  Uniprot ID:  Q93084;
  ENSP ID: ENSP00000380234
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 7298 - protein, 998 aa, Homo sapiens
  Payload ID: 1550;
  Gene Symbol: ATP2A3;
  Gene Name: ATPase, Ca++ transporting, ubiquitous;
  Uniprot ID:  Q93084;
  ENSP ID: ENSP00000380236
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEMSQK

SEQ ID NO: 7299 - protein, 142 aa, Homo sapiens
  Payload ID: 1550;
  Gene Symbol: ATP2A3;
  Gene Name: ATPase, Ca++ transporting, ubiquitous;
  ENSP ID: ENSP00000458865
ESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHGPGTQHRLAVRAAQRGRKQGRNEPEVSAGNRVESPVCTSD

SEQ ID NO: 7300 - protein, 153 aa, Homo sapiens
  Payload ID: 1550;
  Gene Symbol: ATP2A3;
  Gene Name: ATPase, Ca++ transporting, ubiquitous;
  ENSP ID: ENSP00000461480
ESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGARDTASSRCQSCSEREEAGKK

SEQ ID NO: 7301 - protein, 1192 aa, Homo sapiens
  Payload ID: 1551;
  Gene Symbol: ATP8B4;
  Gene Name: ATPase, class I, type 8B, member 4;
  Uniprot ID:  Q8TF62;
  ENSP ID: ENSP00000284509
MFCSEKKLREVERIVKANDREYNEKFQYADNRIHTSKYNILTFLPINLFEQFQRVANAYFLCLLILQLIPEISSLTWFTTIVPLVLVITMTAVKDATDDYFRHKSDNQVNNRQSEVLINSKLQNEKWMNVKVGDIIKLENNQFVAADLLLLSSSEPHGLCYVETAELDGETNLKVRHALSVTSELGADISRLAGFDGIVVCEVPNNKLDKFMGILSWKDSKHSLNNEKIILRGCILRNTSWCFGMVIFAGPDTKLMQNSGKTKFKRTSIDRLMNTLVLWIFGFLICLGIILAIGNSIWESQTGDQFRTFLFWNEGEKSSVFSGFLTFWSYIIILNTVVPISLYVSVEVIRLGHSYFINWDRKMYYSRKAIPAVARTTTLNEELGQIEYIFSDKTGTLTQNIMTFKRCSINGRIYGEVHDDLDQKTEITQEKEPVDFSVKSQADREFQFFDHHLMESIKMGDPKVHEFLRLLALCHTVMSEENSAGELIYQVQSPDEGALVTAARNFGFIFKSRTPETITIEELGTLVTYQLLAFLDFNNTRKRMSVIVRNPEGQIKLYSKGADTILFEKLHPSNEVLLSLTSDHLSEFAGEGLRTLAIAYRDLDDKYFKEWHKMLEDANAATEERDERIAGLYEEIERDLMLLGATAVEDKLQEGVIETVTSLSLANIKIWVLTGDKQETAINIGYACNMLTDDMNDVFVIAGNNAVEVREELRKAKQNLFGQNRNFSNGHVVCEKKQQLELDSIVEETITGDYALIINGHSLAHALESDVKNDLLELACMCKTVICCRVTPLQKAQVVELVKKYRNAVTLAIGDGANDVSMIKSAHIGVGISGQEGLQAVLASDYSFAQFRYLQRLLLVHGRWSYFRMCKFLCYFFYKNFAFTLVHFWFGFFCGFSAQTVYDQWFITLFNIVYTSLPVLAMGIFDQDVSDQNSVDCPQLYKPGQLNLLFNKRKFFICVLHGIYTSLVLFFIPYGAFYNVAGEDGQHIADYQSFAVTMATSLVIVVSVQIALDTSYWTFINHVFIWGSIAIYFSILFTMHSNGIFGIFPNQFPFVGNARHSLTQKCIWLVILLTTVASVMPVVAFRFLKVDLYPTLSDQIRRWQKAQKKARPPSSRRPRTRRSSSRRSGYAFAHQEGYGELITSGKNMRAKNPPPTSGLEKTHYNSTSWIENLCKKTTDTVSSFSQDKTVKL

SEQ ID NO: 7302 - protein, 122 aa, Homo sapiens
  Payload ID: 1551;
  Gene Symbol: ATP8B4;
  Gene Name: ATPase, class I, type 8B, member 4;
  ENSP ID: ENSP00000452956
MFCSEKKLREVERIVKANDREYNEKFQYADNRIHTSKYNILTFLPINLFEQFQRVANAYFLCLLILQLIPEISSLTWFTTIVPLVLVITMTAVKDATDDYFRHKSDNQVNNRQSEVLINSKC

SEQ ID NO: 7303 - protein, 95 aa, Homo sapiens
  Payload ID: 1551;
  Gene Symbol: ATP8B4;
  Gene Name: ATPase, class I, type 8B, member 4;
  ENSP ID: ENSP00000453143
  MOD_RES (1)..(1): Any amino acid
XANAYFLCLLILQLIPEISSLTWFTTIVPLVLVITMTAVKDATDDYFRHKSDNQVNNRQSEVLINSKLQNEKWMNVKVGDIIKLENNQFVALIKD

SEQ ID NO: 7304 - protein, 1192 aa, Homo sapiens; identical to SEQ ID NO: 7301
  Payload ID: 1551;
  Gene Symbol: ATP8B4;
  Gene Name: ATPase, class I, type 8B, member 4;
  Uniprot ID:  Q8TF62;
  ENSP ID: ENSP00000453169

SEQ ID NO: 7305 - protein, 122 aa, Homo sapiens; identical to SEQ ID NO: 7302
  Payload ID: 1551;
  Gene Symbol: ATP8B4;
  Gene Name: ATPase, class I, type 8B, member 4;
  ENSP ID: ENSP00000453229

SEQ ID NO: 7306 - protein, 84 aa, Homo sapiens
  Payload ID: 1551;
  Gene Symbol: ATP8B4;
  Gene Name: ATPase, class I, type 8B, member 4;
  ENSP ID: ENSP00000453482
  MOD_RES (1)..(1): Any amino acid
XFKSRTPETITIEELGTLVTYQLLAFLDFNNTRKRMSVIVRNPEGQIKLYSKGADTILFEKLHPSNEVLLSLTSDHLSEASMVF

SEQ ID NO: 7307 - protein, 53 aa, Homo sapiens
  Payload ID: 1551;
  Gene Symbol: ATP8B4;
  Gene Name: ATPase, class I, type 8B, member 4;
  ENSP ID: ENSP00000453539
MFCSEKKLREVERIVKANDREYNEKFQYADNRIHTSKYNILTFLPINLFEQFQ

SEQ ID NO: 7308 - protein, 717 aa, Homo sapiens
  Payload ID: 1551;
  Gene Symbol: ATP8B4;
  Gene Name: ATPase, class I, type 8B, member 4;
  ENSP ID: ENSP00000453690
MFCSEKKLREVERIVKANDREYNEKFQYADNRIHTSKYNILTFLPINLFEQFQRVANAYFLCLLILQLIPEISSLTWFTTIVPLVLVITMTAVKDATDDYFRHKSDNQVNNRQSEVLINSKLQNEKWMNVKVGDIIKLENNQFVAADLLLLSSSEPHGLCYVETAELDGETNLKVRHALSVTSELGADISRLAGFDGIVVCEVPNNKLDKFMGILSWKDSKHSLNNEKIILRGCILRNTSWCFGMVIFAGPDTKLMQNSGKTKFKRTSIDRLMNTLVLWIFGFLICLGIILAIGNSIWESQTGDQFRTFLFWNEGEKSSVFSGFLTFWSYIIILNTVVPISLYVSVEVIRLGHSYFINWDRKMYYSRKAIPAVARTTTLNEELGQIEYIFSDKTGTLTQNIMTFKRCSINGRIYGEVHDDLDQKTEITQEKEPVDFSVKSQADREFQFFDHHLMESIKMGDPKVHEFLRLLALCHTVMSEENSAGELIYQVQSPDEGALVTAARNFGFIFKSRTPETITIEELGTLVTYQLLAFLDFNNTRKRMSVIVRNPEGQIKLYSKGADTILFEKLHPSNEVLLSLTSDHLSEFAGEGLRTLAIAYRDLDDKYFKEWHKMLEDANAATEERDERIAGLYEEIERDLMLLGATAVEDKLQEGVIETVTSLSLANIKIWVLTGDKQETAINIGYACNMLTDDMNDVFVIAGNNAVEVREELRLMP

SEQ ID NO: 7309 - protein, 911 aa, Homo sapiens
  Payload ID: 1552;
  Gene Symbol: ATP9A;
  Gene Name: ATPase, class II, type 9A;
  ENSP ID: ENSP00000309086
MDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 7310 - protein, 1047 aa, Homo sapiens
  Payload ID: 1552;
  Gene Symbol: ATP9A;
  Gene Name: ATPase, class II, type 9A;
  Uniprot ID:  O75110;
  ENSP ID: ENSP00000342481
MTDNIPLQPVRQKKRMDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 7311 - protein, 1136 aa, Homo sapiens
  Payload ID: 1553;
  Gene Symbol: ATP9B;
  Gene Name: ATPase, class II, type 9B;
  Uniprot ID:  O43861;
  ENSP ID: ENSP00000304500
MADQIPLYPVRSAAAAAANRKRAAYYSAAGPRPGADRHSRYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMDIHSFEGTFTREDSDPPIHESLSIENTLWASTIVASGTVIGVVIYTGKETRSVMNTSNPKNKVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTGTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEECGNMAREGLRTLVVAKKALTEEQYQDFESRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFDVAFITTVTFLWKVSAITVVSCLPLYVLKYLRRKLSPPSYCKLAS

SEQ ID NO: 7312 - protein, 1147 aa, Homo sapiens
  Payload ID: 1553;
  Gene Symbol: ATP9B;
  Gene Name: ATPase, class II, type 9B;
  Uniprot ID:  O43861;
  ENSP ID: ENSP00000398076
MADQIPLYPVRSAAAAAANRKRAAYYSAAGPRPGADRHSRYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMDIHSFEGTFTREDSDPPIHESLSIENTLWASTIVASGTVIGVVIYTGKETRSVMNTSNPKNKVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTGTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEECGNMAREGLRTLVVAKKALTEEQYQDFESRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFGIGRVSFGAFLDVAFITTVTFLWKVSAITVVSCLPLYVLKYLRRKLSPPSYCKLAS

SEQ ID NO: 7313 - protein, 471 aa, Homo sapiens
  Payload ID: 1553;
  Gene Symbol: ATP9B;
  Gene Name: ATPase, class II, type 9B;
  ENSP ID: ENSP00000442794
MPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMDIHSFEGTFTREDSDPPIHESLSIENTLWASTIVASGTVIGVVIYTGKETRSVMNTSNPKNKVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTGASPLLFFLFLYCQNCISILKQLEFLLKMSPNYFTITVKGSSYSGILRIRLKV

SEQ ID NO: 7314 - protein, 145 aa, Homo sapiens
  Payload ID: 1553;
  Gene Symbol: ATP9B;
  Gene Name: ATPase, class II, type 9B;
  ENSP ID: ENSP00000464761
CHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEERSLFQFLNRRREETQLLDA

SEQ ID NO: 7315 - protein, 100 aa, Homo sapiens
  Payload ID: 1553;
  Gene Symbol: ATP9B;
  Gene Name: ATPase, class II, type 9B;
  ENSP ID: ENSP00000465158
MADQIPLYPVRSAAAAAANRKRAAYYSAAGPRPGADRHSRNEHPAPLCMYPTMTARLGWMSPLLTWSALTPPGQWGECLPTAGACGSPGFTHSLLFNVGT

SEQ ID NO: 7316 - protein, 140 aa, Homo sapiens
  Payload ID: 1553;
  Gene Symbol: ATP9B;
  Gene Name: ATPase, class II, type 9B;
  ENSP ID: ENSP00000465269
  MOD_RES (1)..(1): Any amino acid
XIISTMQAVFSSVFYFASVPLYQGFLMVGYATIYTMFPVFSLVLDQDVKPEMAMLYPELYKDLTKSQQDGRSNRRQHERLTSGTSGHVWDPGSFFRIRVSGKGARNAGKILVLQNLPHLGFNKYLPRRHPHVWGPGALRV

SEQ ID NO: 7317 - protein, 18 aa, Homo sapiens
  Payload ID: 1553;
  Gene Symbol: ATP9B;
  Gene Name: ATPase, class II, type 9B;
  ENSP ID: ENSP00000465300
  MOD_RES (1)..(1): Any amino acid
XNTLWASTIVASGWFVGP

SEQ ID NO: 7318 - protein, 80 aa, Homo sapiens
  Payload ID: 1553;
  Gene Symbol: ATP9B;
  Gene Name: ATPase, class II, type 9B;
  ENSP ID: ENSP00000465928
  MOD_RES (1)..(1): Any amino acid
XCGNMAREGLRTLVVAKKALTEEQYQDFEVPQGGRGSREPGEGDGTAVPHRRGGPAAGRRAAHAGDAAQRRDQDMDANRR

SEQ ID NO: 7319 - protein, 188 aa, Homo sapiens
  Payload ID: 1553;
  Gene Symbol: ATP9B;
  Gene Name: ATPase, class II, type 9B;
  ENSP ID: ENSP00000466992
MADQIPLYPVRSAAAAAANRKRAAYYSAAGPRPGADRHSRYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLMT

SEQ ID NO: 7320 - protein, 289 aa, Homo sapiens
  Payload ID: 1553;
  Gene Symbol: ATP9B;
  Gene Name: ATPase, class II, type 9B;
  ENSP ID: ENSP00000467386
MADQIPLYPVRSAAAAAANRKRAAYYSAAGPRPGADRHSRYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGPFFYQCLCLCSETTNGHSQFRRHIYQGRQ

SEQ ID NO: 7321 - protein, 37 aa, Homo sapiens
  Payload ID: 1553;
  Gene Symbol: ATP9B;
  Gene Name: ATPase, class II, type 9B;
  ENSP ID: ENSP00000467657
  MOD_RES (1)..(1): Any amino acid
XLDQDVKPEMAMLYPELYKDLTKFAKVAQTAALCVVV

SEQ ID NO: 7322 - protein, 200 aa, Homo sapiens
  Payload ID: 1553;
  Gene Symbol: ATP9B;
  Gene Name: ATPase, class II, type 9B;
  ENSP ID: ENSP00000467935
LVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQVCHHIHHVPSVLLSAGPGREARDGDALPGAVQGPHQGKILVLQNLPHLGFNKYLPRRHPHVWGPGALRV

SEQ ID NO: 7323 - protein, 192 aa, Homo sapiens
  Payload ID: 1553;
  Gene Symbol: ATP9B;
  Gene Name: ATPase, class II, type 9B;
  ENSP ID: ENSP00000468218
MADQIPLYPVRSAAAAAANRKRAAYYSAAGPRPGADRHSSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDM

SEQ ID NO: 7324 - protein, 140 aa, Homo sapiens
  Payload ID: 1553;
  Gene Symbol: ATP9B;
  Gene Name: ATPase, class II, type 9B;
  ENSP ID: ENSP00000468540
FSDENRTYQASSPDEVALVQWTESVGLTLVSRDLTSMQLKTPSGQVLSFCILQLFPFTSESKRMGVIVRDESTAEITFYMKGADVAMSPIVQYNDWLEEEETGRDTAVGCIKKGARPTPLLQPFLPSLQPPVQRQIQSTG

SEQ ID NO: 7325 - protein, 39 aa, Homo sapiens
  Payload ID: 1553;
  Gene Symbol: ATP9B;
  Gene Name: ATPase, class II, type 9B;
  ENSP ID: ENSP00000482146
MADQIPLYPVRSAAAAAANRKRAAYYSAAGPRPGADRHS

SEQ ID NO: 7326 - protein, 39 aa, Homo sapiens; identical to SEQ ID NO: 7325
  Payload ID: 1553;
  Gene Symbol: ATP9B;
  Gene Name: ATPase, class II, type 9B;
  ENSP ID: ENSP00000487938

SEQ ID NO: 7327 - protein, 39 aa, Homo sapiens; identical to SEQ ID NO: 7325
  Payload ID: 1553;
  Gene Symbol: ATP9B;
  Gene Name: ATPase, class II, type 9B;
  ENSP ID: ENSP00000488288

SEQ ID NO: 7328 - protein, 39 aa, Homo sapiens; identical to SEQ ID NO: 7325
  Payload ID: 1553;
  Gene Symbol: ATP9B;
  Gene Name: ATPase, class II, type 9B;
  ENSP ID: ENSP00000488597

SEQ ID NO: 7329 - protein, 39 aa, Homo sapiens; identical to SEQ ID NO: 7325
  Payload ID: 1553;
  Gene Symbol: ATP9B;
  Gene Name: ATPase, class II, type 9B;
  ENSP ID: ENSP00000488784

SEQ ID NO: 7330 - protein, 98 aa, Homo sapiens
  Payload ID: 1553;
  Gene Symbol: ATP9B;
  Gene Name: ATPase, class II, type 9B;
  ENSP ID: ENSP00000488793
MADQIPLYPVRSAAAAAANRKRAAYYSAAGPRPGADRHSRNEHPAPLCMYPTMTARLGWMSPLLTWSALTPPGQWGECLPTAGACGSPGFTHSLLFNV

SEQ ID NO: 7331 - protein, 39 aa, Homo sapiens; identical to SEQ ID NO: 7325
  Payload ID: 1553;
  Gene Symbol: ATP9B;
  Gene Name: ATPase, class II, type 9B;
  ENSP ID: ENSP00000488805

SEQ ID NO: 7332 - protein, 1499 aa, Homo sapiens
  Payload ID: 1554;
  Gene Symbol: ATP10A;
  Gene Name: ATPase, class V, type 10A;
  Uniprot ID:  O60312;
  ENSP ID: ENSP00000349325
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSREEKKYVNRFWKEIHVGDFVRLRCNEIFPADILLLSSSDPDGLCHIETANLDGETNLKRRQVVRGFSELVSEFNPLTFTSVIECEKPNNDLSRFRGCIIHDNGKKAGLYKENLLLRGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRRCTVSGVEYSHDANAQRLARYQEADSEEEEVVPRGGSVSQRGSIGSHQSVRVVHRTQSTKSHRRTGSRAEAKRASMLSKHTAFSSPMEKDITPDPKLLEKVSECDKSLAVARHQEHLLAHLSPELSDVFDFFIALTICNTVVVTSPDQPRTKVRVRFELKSPVKTIEDFLRRFTPSCLTSGCSSIGSLAANKSSHKLGSSFPSTPSSDGMLLRLEERLGQPTSAIASNGYSSQADNWASELAQEQESERELRYEAESPDEAALVYAARAYNCVLVERLHDQVSVELPHLGRLTFELLHTLGFDSVRKRMSVVIRHPLTDEINVYTKGADSVVMDLLQPCSSVDARGRHQKKIRSKTQNYLNVYAAEGLRTLCIAKRVLSKEEYACWLQSHLEAESSLENSEELLFQSAIRLETNLHLLGATGIEDRLQDGVPETISKLRQAGLQIWVLTGDKQETAVNIAYACKLLDHDEEVITLNATSQEACAALLDQCLCYVQSRGLQRAPEKTKGKVSMRFSSLCPPSTSTASGRRPSLVIDGRSLAYALEKNLEDKFLFLAKQCRSVLCCRSTPLQKSMVVKLVRSKLKAMTLAIGDGANDVSMIQVADVGVGISGQEGMQAVMASDFAVPKFRYLERLLILHGHWCYSRLANMVLYFFYKNTMFVGLLFWFQFFCGFSASTMIDQWYLIFFNLLFSSLPPLVTGVLDRDVPANVLLTNPQLYKSGQNMEEYRPRTFWFNMADAAFQSLVCFSIPYLAYYDSNVDLFTWGTPIVTIALLTFLLHLGIETKTWTWLNWITCGFSVLLFFTVALIYNASCATCYPPSNPYWTMQALLGDPVFYLTCLMTPVAALLPRLFFRSLQGRVFPTQLQLARQLTRKSPRRCSAPKETFAQGRLPKDSGTEHSSGRTVKTSVPLSQPSWHTQQPVCSLEASGEPSTVDMSMPVREHTLLEGLSAPAPMSSAPGEAVLRSPGGCPEESKVRAASTGRVTPLSSLFSLPTFSLLNWISSWSLVSRLGSVLQFSRTEQLADGQAGRGLPVQPHSGRSGLQGPDHRLLIGASSRRSQ

SEQ ID NO: 7333 - protein, 155 aa, Homo sapiens
  Payload ID: 1554;
  Gene Symbol: ATP10A;
  Gene Name: ATPase, class V, type 10A;
  Uniprot ID:  O60312;
  ENSP ID: ENSP00000374617
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSSRSHLK

SEQ ID NO: 7334 - protein, 594 aa, Homo sapiens
  Payload ID: 1554;
  Gene Symbol: ATP10A;
  Gene Name: ATPase, class V, type 10A;
  ENSP ID: ENSP00000450480
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSREEKKYVNRFWKEIHVGDFVRLRCNEIFPADILLLSSSDPDGLCHIETANLDGETNLKRRQVVRGFSELVSEFNPLTFTSVIECEKPNNDLSRFRGCIIHDNGKKAGLYKENLLLRGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRRCTVSGVEYSHDANAQRLARYQEADSEEEEVVPRGGSVSQRGSIGSHQSVRVVHRTQSTKSHRRTGSRAEAKRASMLSKHTAFSSPMEKDITPDPKLLEKVSECDKSLAVARHQEHLLAHLSPELSDVFDFFIALTICNTVVVTSPDQPRTKAR

SEQ ID NO: 7335 - protein, 139 aa, Homo sapiens
  Payload ID: 1554;
  Gene Symbol: ATP10A;
  Gene Name: ATPase, class V, type 10A;
  ENSP ID: ENSP00000451615
AIGDGANDVSMIQVADVGVGISGQEGMQEMLRETTAMETLAGHARTVFRMGIFLPCCVPCILRREDKSDARSASPVTGIPLPLKAVMASDFAVPKFRYLERLLILHGHWCYSRLANMVLYFFYKNTMFVGLLFWFQFFC

SEQ ID NO: 7336 - protein, 155 aa, Homo sapiens; identical to SEQ ID NO: 7333
  Payload ID: 1554;
  Gene Symbol: ATP10A;
  Gene Name: ATPase, class V, type 10A;
  Uniprot ID:  O60312;
  ENSP ID: ENSP00000480665

SEQ ID NO: 7337 - protein, 1461 aa, Homo sapiens
  Payload ID: 1555;
  Gene Symbol: ATP10B;
  Gene Name: ATPase, class V, type 10B;
  Uniprot ID:  O94823;
  ENSP ID: ENSP00000313600
MALSVDSSWHRWQWRVRDGFPHCPSETTPLLSPEKGRQSYNLTQQRVVFPNNSIFHQDWEEVSRRYPGNRTCTTKYTLFTFLPRNLFEQFHRWANLYFLFLVILNWMPSMEVFHREITMLPLAIVLFVIMIKDGMEDFKRHRFDKAINCSNIRIYERKEQTYVQKCWKDVRVGDFIQMKCNEIVPADILLLFSSDPNGICHLETASLDGETNLKQRCVVKGFSQQEVQFEPELFHNTIVCEKPNNHLNKFKGYMEHPDQTRTGFGCESLLLRGCTIRNTEMAVGIVIYAGHETKAMLNNSGPRYKRSKIERRMNIDIFFCIGILILMCLIGAVGHSIWNGTFEEHPPFDVPDANGSFLPSALGGFYMFLTMIILLQVLIPISLYVSIELVKLGQVFFLSNDLDLYDEETDLSIQCRALNIAEDLGQIQYIFSDKTGTLTENKMVFRRCTIMGSEYSHQENAKRLETPKELDSDGEEWTQYQCLSFSARWAQDPATMRSQKGAQPLRRSQSARVPIQGHYRQRSMGHRESSQPPVAFSSSIEKDVTPDKNLLTKVRDAALWLETLSDSRPAKASLSTTSSIADFFLALTICNSVMVSTTTEPRQRVTIKPSSKALGTSLEKIQQLFQKLKLLSLSQSFSSTAPSDTDLGESLGANVATTDSDERDDASVCSGGDSTDDGGYRSSMWDQGDILESGSGTSLEEALEAPATDLARPEFCYEAESPDEAALVHAAHAYSFTLVSRTPEQVTVRLPQGTCLTFSLLCTLGFDSVRKRMSVVVRHPLTGEIVVYTKGADSVIMDLLEDPACVPDINMEKKLRKIRARTQKHLDLYARDGLRTLCIAKKVVSEEDFRRWASFRREAEASLDNRDELLMETAQHLENQLTLLGATGIEDRLQEGVPDTIATLREAGIQLWVLTGDKQETAVNIAHSCRLLNQTDTVYTINTENQETCESILNCALEELKQFRELQKPDRKLFGFRLPSKTPSITSEAVVPEAGLVIDGKTLNAIFQGKLEKKFLELTQYCRSVLCCRSTPLQKSMIVKLVRDKLRVMTLSIGDGANDVSMIQAADIGIGISGQEGMQAVMSSDFAITRFKHLKKLLLVHGHWCYSRLARMVVYYLYKNVCYVNLLFWYQFFCGFSSSTMIDYWQMIFFNLFFTSLPPLVFGVLDKDISAETLLALPELYKSGQNSECYNLSTFWISMVDAFYQSLICFFIPYLAYKGSDIDVFTFGTPINTISLTTILLHQAMEMKTWTIFHGVVLLGSFLMYFLVSLLYNATCVICNSPTNPYWVMEGQLSNPTFYLVCFLTPVVALLPRYFFLSLQGTCGKSLISKAQKIDKLPPDKRNLEIQSWRSRQRPAPVPEVARPTHHPVSSITGQDFSASTPKSSNPPKRKHVEESVLHEQRCGTECMRDDSCSGDSSAQLSSGEHLLGPNRIMAYSRGQTDMCRCSKRSSHRRSQSSLTI

SEQ ID NO: 7338 - protein, 556 aa, Homo sapiens
  Payload ID: 1555;
  Gene Symbol: ATP10B;
  Gene Name: ATPase, class V, type 10B;
  ENSP ID: ENSP00000431081
GQVFFLSNDLDLYDEETDLSIQCRALNIAEDLGQIQYIFSDKTGTLTENKMVFRRCTIMGSEYSHQENAKRLETPKELDSDGEEWTQYQCLSFSARWAQDPATMRSQKGAQPLRRSQSARVPIQGHYRQRSMGHRESSQPPVAFSSSIEKDVTPDKNLLTKVRDAALWLETLSDSRPAKASLSTTSSIADFFLALTICNSVMVSTTTEPRQRVTIKPSSKALGTSLEKIQQLFQKLKLLSLSQSFSSTAPSDTDLGESLGANVATTDSDERDDASVCSGGDSTDDGGYRSSMWDQGDILESGSGTSLEEALEAPATDLARPEFCYEAESPDEAALVHAAHAYSFTLVSRTPEQVTVRLPQGTCLTFSLLCTLGFDSVRKRMSVVVRHPLTGEIVVYTKGADSVIMDLLEDPACVPDINMEKKLRKIRARTQKHLDLYARDGLRTLCIAKKVVSEEDFRRWASFRREAEASLDNRDELLMETAQHLENQLTLLGATGIEDRLQEGVPDTIATLREAGIQLWVLTGDKQETAVNIAHSCRLLNQTDTVYTINTENQVR

SEQ ID NO: 7339 - protein, 1426 aa, Homo sapiens
  Payload ID: 1556;
  Gene Symbol: ATP10D;
  Gene Name: ATPase, class V, type 10D;
  Uniprot ID:  Q9P241;
  ENSP ID: ENSP00000273859
MTEALQWARYHWRRLIRGATRDDDSGPYNYSSLLACGRKSSQTPKLSGRHRIVVPHIQPFKDEYEKFSGAYVNNRIRTTKYTLLNFVPRNLFEQFHRAANLYFLFLVVLNWVPLVEAFQKEITMLPLVVVLTIIAIKDGLEDYRKYKIDKQINNLITKVYSRKEKKYIDRCWKDVTVGDFIRLSCNEVIPADMVLLFSTDPDGICHIETSGLDGESNLKQRQVVRGYAEQDSEVDPEKFSSRIECESPNNDLSRFRGFLEHSNKERVGLSKENLLLRGCTIRNTEAVVGIVVYAGHETKAMLNNSGPRYKRSKLERRANTDVLWCVMLLVIMCLTGAVGHGIWLSRYEKMHFFNVPEPDGHIISPLLAGFYMFWTMIILLQVLIPISLYVSIEIVKLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIETDVVPDTRLLDKFSQITPRLFMPLDETIQNPPMETLYIIDFFIALAICNTVVVSAPNQPRQKIRHPSLGGLPIKSLEEIKSLFQRWSVRRSSSPSLNSGKEPSSGVPNAFVSRLPLFSRMKPASPVEEEVSQVCESPQCSSSSACCTETEKQHGDAGLLNGKAESLPGQPLACNLCYEAESPDEAALVYAARAYQCTLRSRTPEQVMVDFAALGPLTFQLLHILPFDSVRKRMSVVVRHPLSNQVVVYTKGADSVIMELLSVASPDGASLEKQQMIVREKTQKHLDDYAKQGLRTLCIAKKVMSDTEYAEWLRNHFLAETSIDNREELLLESAMRLENKLTLLGATGIEDRLQEGVPESIEALHKAGIKIWMLTGDKQETAVNIAYACKLLEPDDKLFILNTQSKDACGMLMSTILKELQKKTQALPEQVSLSEDLLQPPVPRDSGLRAGLIITGKTLEFALQESLQKQFLELTSWCQAVVCCRATPLQKSEVVKLVRSHLQVMTLAIGDGANDVSMIQVADIGIGVSGQEGMQAVMASDFAVSQFKHLSKLLLVHGHWCYTRLSNMILYFFYKNVAYVNLLFWYQFFCGFSGTSMTDYWVLIFFNLLFTSAPPVIYGVLEKDVSAETLMQLPELYRSGQKSEAYLPHTFWITLLDAFYQSLVCFFVPYFTYQGSDTDIFAFGNPLNTAALFIVLLHLVIESKSLTWIHLLVIIGSILSYFLFAIVFGAMCVTCNPPSNPYWIMQEHMLDPVFYLVCILTTSIALLPRFVYRVLQGSLFPSPILRAKHFDRLTPEERTKALKKWRGAGKMNQVTSKYANQSAGKSGRRPMPGPSAVFAMKSASSCAIEQGNLSLCETALDQGYSETKAFEMAGPSKGKES

SEQ ID NO: 7340 - protein, 535 aa, Homo sapiens
  Payload ID: 1556;
  Gene Symbol: ATP10D;
  Gene Name: ATPase, class V, type 10D;
  ENSP ID: ENSP00000420909
MTEALQWARYHWRRLIRGATRDDDSGPYNYSSLLACGRKSSQTPKLSGRHRIVVPHIQPFKDEYEKFSGAYVNNRIRTTKYTLLNFVPRNLFEQFHRAANLYFLFLVVLNWVPLVEAFQKEITMLPLVVVLTIIAIKDGLEDYRKYKIDKQINNLITKVYSRKEKKYIDRCWKDVTVGDFIRLSCNEVIPADMVLLFSTDPDGICHIETSGLDGESNLKQRQVVRGYAEQDSEVDPEKFSSRIECESPNNDLSRFRGFLEHSNKERVGLSKENLLLRGCTIRNTEAVVGIVVYAGHETKAMLNNSGPRYKRSKLERRANTDVLWCVMLLVIMCLTGAVGHGIWLSRYEKMHFFNVPEPDGHIISPLLAGFYMFWTMIILLQLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIVSMNA

SEQ ID NO: 7341 - protein, 224 aa, Homo sapiens
  Payload ID: 1556;
  Gene Symbol: ATP10D;
  Gene Name: ATPase, class V, type 10D;
  ENSP ID: ENSP00000421536
  MOD_RES (1)..(1): Any amino acid
XNVPEPDGHIISPLLAGFYMFWTMIILLQVLIPISLYVSIEIVKLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIETDVVPDTRAGHGGLCCFGTINISTPTHPAL

SEQ ID NO: 7342 - protein, 1191 aa, Homo sapiens
  Payload ID: 1557;
  Gene Symbol: ATP11A;
  Gene Name: ATPase, class VI, type 11A;
  ENSP ID: ENSP00000364781
MDCSLVRTLVHRYCAGEENWVDSRTIYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVEKSMNAFLIVYLCILISKALINTVLKYMWQSEPFRDEPWYNQKTESERQRNLFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQNGCAQPRDRDSEFTPLASLQSPGYQSTCPSAAWYSSHSQQVTLAAWKEKVSTEPPPILGGSHHHCSSIPSHSCPRSRVGMLV

SEQ ID NO: 7343 - protein, 1134 aa, Homo sapiens
  Payload ID: 1557;
  Gene Symbol: ATP11A;
  Gene Name: ATPase, class VI, type 11A;
  Uniprot ID:  P98196;
  ENSP ID: ENSP00000364796
MDCSLVRTLVHRYCAGEENWVDSRTIYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVEKSMNAFLIVYLCILISKALINTVLKYMWQSEPFRDEPWYNQKTESERQRNLFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQTKSQCLSVEQSTIFMLSQTSSSLSF

SEQ ID NO: 7344 - protein, 935 aa, Homo sapiens
  Payload ID: 1557;
  Gene Symbol: ATP11A;
  Gene Name: ATPase, class VI, type 11A;
  ENSP ID: ENSP00000396374
  MOD_RES (1)..(1): Any amino acid
XYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVEKSMNAFLIVYLCILISKALINTVLKYMWQSEPFRDEPWYNQKTESERQRNLFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRYHPPNSLS

SEQ ID NO: 7345 - protein, 75 aa, Homo sapiens
  Payload ID: 1557;
  Gene Symbol: ATP11A;
  Gene Name: ATPase, class VI, type 11A;
  ENSP ID: ENSP00000402575
  MOD_RES (1)..(1): Any amino acid
XFIQMLSSGPAWLAIVLLVTISLLPDVLKKVLCRQLWPTATERVQRGVKHKAPVQAAQSSDGPLLKDLLRRPRRS

SEQ ID NO: 7346 - protein, 183 aa, Homo sapiens
  Payload ID: 1557;
  Gene Symbol: ATP11A;
  Gene Name: ATPase, class VI, type 11A;
  ENSP ID: ENSP00000410824
FTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQNGCAQPRDRDSEFTPLASLQSPGYQSTCPSAAWYSSHSQQVTLAAWKEKVSTEPPPILGGSHHHCSSIPSHSCPRSRVGMLV

SEQ ID NO: 7347 - protein, 1134 aa, Homo sapiens; identical to SEQ ID NO: 7343
  Payload ID: 1557;
  Gene Symbol: ATP11A;
  Gene Name: ATPase, class VI, type 11A;
  Uniprot ID:  P98196;
  ENSP ID: ENSP00000420387

SEQ ID NO: 7348 - protein, 352 aa, Homo sapiens
  Payload ID: 1557;
  Gene Symbol: ATP11A;
  Gene Name: ATPase, class VI, type 11A;
  ENSP ID: ENSP00000420696
  MOD_RES (1)..(1): Any amino acid
XSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQGRRQECPAALARVHLLDAPGTV

SEQ ID NO: 7349 - protein, 62 aa, Homo sapiens
  Payload ID: 1557;
  Gene Symbol: ATP11A;
  Gene Name: ATPase, class VI, type 11A;
  ENSP ID: ENSP00000479392
DMQDYGLIIDGAALSLIMKPREDGSSGNYRELFLEICRSCSAVLCCRMAPLQKAQVLPARPR

SEQ ID NO: 7350 - protein, 1177 aa, Homo sapiens
  Payload ID: 1558;
  Gene Symbol: ATP11B;
  Gene Name: ATPase, class VI, type 11B;
  Uniprot ID:  Q9Y2G3;
  ENSP ID: ENSP00000321195
MWRWIRQQLGFDPPHQSDTRTIYVANRFPQNGLYTPQKFIDNRIISSKYTVWNFVPKNLFEQFRRVANFYFLIIFLVQLMIDTPTSPVTSGLPLFFVITVTAIKQGYEDWLRHNSDNEVNGAPVYVVRSGGLVKTRSKNIRVGDIVRIAKDEIFPADLVLLSSDRLDGSCHVTTASLDGETNLKTHVAVPETALLQTVANLDTLVAVIECQQPEADLYRFMGRMIITQQMEEIVRPLGPESLLLRGARLKNTKEIFGVAVYTGMETKMALNYKSKSQKRSAVEKSMNTFLIIYLVILISEAVISTILKYTWQAEEKWDEPWYNQKTEHQRNSSKILRFISDFLAFLVLYNFIIPISLYVTVEMQKFLGSFFIGWDLDLYHEESDQKAQVNTSDLNEELGQVEYVFTDKTGTLTENEMQFRECSINGMKYQEINGRLVPEGPTPDSSEGNLSYLSSLSHLNNLSHLTTSSSFRTSPENETELIKEHDLFFKAVSLCHTVQISNVQTDCTGDGPWQSNLAPSQLEYYASSPDEKALVEAAARIGIVFIGNSEETMEVKTLGKLERYKLLHILEFDSDRRRMSVIVQAPSGEKLLFAKGAESSILPKCIGGEIEKTRIHVDEFALKGLRTLCIAYRKFTSKEYEEIDKRIFEARTALQQREEKLAAVFQFIEKDLILLGATAVEDRLQDKVRETIEALRMAGIKVWVLTGDKHETAVSVSLSCGHFHRTMNILELINQKSDSECAEQLRQLARRITEDHVIQHGLVVDGTSLSLALREHEKLFMEVCRNCSAVLCCRMAPLQKAKVIRLIKISPEKPITLAVGDGANDVSMIQEAHVGIGIMGKEGRQAARNSDYAIARFKFLSKLLFVHGHFYYIRIATLVQYFFYKNVCFITPQFLYQFYCLFSQQTLYDSVYLTLYNICFTSLPILIYSLLEQHVDPHVLQNKPTLYRDISKNRLLSIKTFLYWTILGFSHAFIFFFGSYLLIGKDTSLLGNGQMFGNWTFGTLVFTVMVITVTVKMALETHFWTWINHLVTWGSIIFYFVFSLFYGGILWPFLGSQNMYFVFIQLLSSGSAWFAIILMVVTCLFLDIIKKVFDRHLHPTSTEKAQLTETNAGIKCLDSMCCFPEGEAACASVGRMLERVIGRCSPTHISRSWSASDPFYTNDRSILTLSTMDSSTC

SEQ ID NO: 7351 - protein, 238 aa, Homo sapiens
  Payload ID: 1558;
  Gene Symbol: ATP11B;
  Gene Name: ATPase, class VI, type 11B;
  ENSP ID: ENSP00000417124
GTSLSLALREHEKLFMEVCRNCSAVLCCRMAPLQKAKVIRLIKISPEKPITLAVGDGANDVSMIQEAHVGIGIMGKEGRQAARNSDYAIARFKFLSKLLFVHGHFYYIRIATLVQYFFYKTLYDSVYLTLYNICFTSLPILIYSLLEQHVDPHVLQNKPTLYRDISKNRLLSIKTFLYWTILGFSHAFIFFFGSYLLIGKDTSLLGNGQMFGNWTFGTLVFTVMVITVTVKMALETHF

SEQ ID NO: 7352 - protein, 108 aa, Homo sapiens
  Payload ID: 1558;
  Gene Symbol: ATP11B;
  Gene Name: ATPase, class VI, type 11B;
  ENSP ID: ENSP00000417406
QKSDSECAEQLRQLARRITEDHVIQHGLVVDGTSLSLALREHEKLFMEVCRNCSAVLCCRMAPLQKAKVIRLIKISPEKPITLAVGDGANDESWVKKEDRLQETVTMQ

SEQ ID NO: 7353 - protein, 970 aa, Homo sapiens
  Payload ID: 1558;
  Gene Symbol: ATP11B;
  Gene Name: ATPase, class VI, type 11B;
  ENSP ID: ENSP00000418421
  MOD_RES (1)..(1): Any amino acid
XLDTLVAVIECQQPEADLYRFMGRMIITQQMEEIVRPLGPESLLLRGARLKNTKEIFGVAVYTGMETKMALNYKSKSQKRSAVEKSMNTFLIIYLVILISEAVISTILKYTWQAEEKWDEPWYNQKTEHQRNSSKILRFISDFLAFLVLYNFIIPISLYVTVEMQKFLGSFFIGWDLDLYHEESDQKAQVNTSDLNEELGQVEYVFTDKTGTLTENEMQFRECSINGMKYQEINGRLVPEGPTPDSSEGNLSYLSSLSHLNNLSHLTTSSSFRTSPENETELIKEHDLFFKAVSLCHTVQISNVQTDCTGDGPWQSNLAPSQLEYYASSPDEKALVEAAARIGIVFIGNSEETMEVKTLGKLERYKLLHILEFDSDRRRMSVIVQAPSGEKLLFAKGAESSILPKCIGGEIEKTRIHVDEFALKGLRTLCIAYRKFTSKEYEEIDKRIFEARTALQQREEKLAAVFQFIEKDLILLGATAVEDRLQDKVRETIEALRMAGIKVWVLTGDKHETAVSVSLSCGHFHRTMNILELINQKSDSECAEQLRQLARRITEDHVIQHGLVVDGTSLSLALREHEKLFMEVCRNCSAVLCCRMAPLQKAKVIRLIKISPEKPITLAVGDGANDVSMIQEAHVGIGIMGKEGRQAARNSDYAIARFKFLSKLLFVHGHFYYIRIATLVQYFFYKNVCFITPQFLYQFYCLFSQQTLYDSVYLTLYNICFTSLPILIYSLLEQHVDPHVLQNKPTLYRDISKNRLLSIKTFLYWTILGFSHAFIFFFGSYLLIGKDTSLLGNGQMFGNWTFGTLVFTVMVITVTVKMALETHFWTWINHLVTWGSIIFYFVFSLFYGGILWPFLGSQNMYFVFIQLLSSGSAWFAIILMVVTCLFLDIIKKVFDRHLHPTSTEKAQMYSNTVALSDEFIALQPLSRARNQLSKLSLLKQMQVSSAWTPCAVSRKEKQRVHLLEECWNEL

SEQ ID NO: 7354 - protein, 195 aa, Homo sapiens
  Payload ID: 1558;
  Gene Symbol: ATP11B;
  Gene Name: ATPase, class VI, type 11B;
  ENSP ID: ENSP00000419032
MWRWIRQQLGFDPPHQSDTRTIYVANRFPQNGLYTPQKFIDNRIISSKYTVWNFVPKNLFEQFRRVANFYFLIIFLVQLMIDTPTSPVTSGLPLFFVITVTAIKQGYEDWLRHNSDNEVNGAPVYVVRSGGLVKTRSKNIRVGDIVRIAKDEIFPADLVLLSSDRLDGSCHVTTASLDGETNLKVCLHMFEYCSW

SEQ ID NO: 7355 - protein, 119 aa, Homo sapiens
  Payload ID: 1558;
  Gene Symbol: ATP11B;
  Gene Name: ATPase, class VI, type 11B;
  ENSP ID: ENSP00000419152
  MOD_RES (1)..(1): Any amino acid
XPFLGSQNMYFVFIQLLSSGSAWFAIILMVVTCLFLDIIKKVFDRHLHPTSTEKAQMYSNTVALSDEFIALQPLSRARNQLSKLSLLKQMQVSSAWTPCAVSRKEKQRVHLLEECWNEL

SEQ ID NO: 7356 - protein, 147 aa, Homo sapiens
  Payload ID: 1558;
  Gene Symbol: ATP11B;
  Gene Name: ATPase, class VI, type 11B;
  ENSP ID: ENSP00000419768
  MOD_RES (1)..(1): Any amino acid
XMALETHFWTWINHLVTWGSIIFYFVFSLFYGGILWPFLGSQNMYFVFIQLLSSGSAWFAIILMVVTCLFLDIIKKVFDRHLHPTSTEKAQLTETNAGIKCLDSMCCFPEGEAACASVGRMLERVIGRCSPTHISRCEISLSSLCCR

SEQ ID NO: 7357 - protein, 1132 aa, Homo sapiens
  Payload ID: 1559;
  Gene Symbol: ATP11C;
  Gene Name: ATPase, class VI, type 11C;
  Uniprot ID:  Q8NB49;
  ENSP ID: ENSP00000332756
MQMVPSLPPASECAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGIKGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARRNLSCRRASDSLSARPSVRPLLLRTFSDESNVL

SEQ ID NO: 7358 - protein, 1119 aa, Homo sapiens
  Payload ID: 1559;
  Gene Symbol: ATP11C;
  Gene Name: ATPase, class VI, type 11C;
  Uniprot ID:  Q8NB49;
  ENSP ID: ENSP00000355165
MQMVPSLPPASECAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGIKGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARNPNLELPMLLSYKHTDSGYS

SEQ ID NO: 7359 - protein, 1113 aa, Homo sapiens
  Payload ID: 1559;
  Gene Symbol: ATP11C;
  Gene Name: ATPase, class VI, type 11C;
  ENSP ID: ENSP00000359588
MFRRSLNRFCAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARNPNLELPMLLSYKHTDSGYS

SEQ ID NO: 7360 - protein, 172 aa, Homo sapiens
  Payload ID: 1559;
  Gene Symbol: ATP11C;
  Gene Name: ATPase, class VI, type 11C;
  ENSP ID: ENSP00000391259
TLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARVHHLISSSA

SEQ ID NO: 7361 - protein, 202 aa, Homo sapiens
  Payload ID: 1559;
  Gene Symbol: ATP11C;
  Gene Name: ATPase, class VI, type 11C;
  ENSP ID: ENSP00000394573
  MOD_RES (1)..(1): Any amino acid
XECCIDGHKYKGVTQEVDGLSQTDGTLTYFDKVDKNREELFLRALCLCHTVEIKTNDAVDGATESAELTYISSSPDEIALVKGAKRYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATA

SEQ ID NO: 7362 - protein, 165 aa, Homo sapiens
  Payload ID: 1559;
  Gene Symbol: ATP11C;
  Gene Name: ATPase, class VI, type 11C;
  ENSP ID: ENSP00000397923
  MOD_RES (1)..(1): Any amino acid
XEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARRNLSCRRASDSLSARPSVRPLLLRTFSDESNVL

SEQ ID NO: 7363 - protein, 1422 aa, Homo sapiens
  Payload ID: 1560;
  Gene Symbol: ATP7A;
  Gene Name: ATPase, Cu++ transporting, alpha polypeptide;
  Uniprot ID:  Q04656;
  ENSP ID: ENSP00000343026
MDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERLKNTPVKSSEGSQQRSPSYTNDSTATFIIDGMHCKSCVSNIESTLSALQYVSSIVVSLENRSAIVKYNASSVTPESLRKAIEAVSPGLYRVSITSEVESTSNSPSSSSLQKIPLNVVSQPLTQETVINIDGMTCNSCVQSIEGVISKKPGVKSIRVSLANSNGTVEYDPLLTSPETLRGAIEDMGFDATLSDTNEPLVVIAQPSSEMPLLTSTNEFYTKGMTPVQDKEEGKNSSKCYIQVTGMTCASCVANIERNLRREEGIYSILVALMAGKAEVRYNPAVIQPPMIAEFIRELGFGATVIENADEGDGVLELVVRGMTCASCVHKIESSLTKHRGILYCSVALATNKAHIKYDPEIIGPRDIIHTIESLGFEASLVKKDRSASHLDHKREIRQWRRSFLVSLFFCIPVMGLMIYMMVMDHHFATLHHNQNMSKEEMINLHSSMFLERQILPGLSVMNLLSFLLCVPVQGKTSEALAKLISLQATEATIVTLDSDNILLSEEQVDVELVQRGDIIKVVPGGKFPVDGRVIEGHSMVDESLITGEAMPVAKKPGSTVIAGSINQNGSLLICATHVGADTTLSQIVKLVEEAQTSKAPIQQFADKLSGYFVPFIVFVSIATLLVWIVIGFLNFEIVETYFPGYNRSISRTETIIRFAFQASITVLCIACPCSLGLATPTAVMVGTGVGAQNGILIKGGEPLEMAHKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRKTVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 7364 - protein, 274 aa, Homo sapiens [sequence omitted]

SEQ ID NO: 7365 - protein, 1500 aa, Homo sapiens
  Payload ID: 1560;
  Gene Symbol: ATP7A;
  Gene Name: ATPase, Cu++ transporting, alpha polypeptide;
  Uniprot ID:  Q04656;
  ENSP ID: ENSP00000345728
MDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERLKNTPVKSSEGSQQRSPSYTNDSTATFIIDGMHCKSCVSNIESTLSALQYVSSIVVSLENRSAIVKYNASSVTPESLRKAIEAVSPGLYRVSITSEVESTSNSPSSSSLQKIPLNVVSQPLTQETVINIDGMTCNSCVQSIEGVISKKPGVKSIRVSLANSNGTVEYDPLLTSPETLRGAIEDMGFDATLSDTNEPLVVIAQPSSEMPLLTSTNEFYTKGMTPVQDKEEGKNSSKCYIQVTGMTCASCVANIERNLRREEGIYSILVALMAGKAEVRYNPAVIQPPMIAEFIRELGFGATVIENADEGDGVLELVVRGMTCASCVHKIESSLTKHRGILYCSVALATNKAHIKYDPEIIGPRDIIHTIESLGFEASLVKKDRSASHLDHKREIRQWRRSFLVSLFFCIPVMGLMIYMMVMDHHFATLHHNQNMSKEEMINLHSSMFLERQILPGLSVMNLLSFLLCVPVQFFGGWYFYIQAYKALKHKTANMDVLIVLATTIAFAYSLIILLVAMYERAKVNPITFFDTPPMLFVFIALGRWLEHIAKGKTSEALAKLISLQATEATIVTLDSDNILLSEEQVDVELVQRGDIIKVVPGGKFPVDGRVIEGHSMVDESLITGEAMPVAKKPGSTVIAGSINQNGSLLICATHVGADTTLSQIVKLVEEAQTSKAPIQQFADKLSGYFVPFIVFVSIATLLVWIVIGFLNFEIVETYFPGYNRSISRTETIIRFAFQASITVLCIACPCSLGLATPTAVMVGTGVGAQNGILIKGGEPLEMAHKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRKTVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 7366 - protein, 1465 aa, Homo sapiens
  Payload ID: 1561;
  Gene Symbol: ATP7B;
  Gene Name: ATPase, Cu++ transporting, beta polypeptide;
  Uniprot ID:  P35670;
  ENSP ID: ENSP00000242839
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 7367 - protein, 1258 aa, Homo sapiens
  Payload ID: 1561;
  Gene Symbol: ATP7B;
  Gene Name: ATPase, Cu++ transporting, beta polypeptide;
  Uniprot ID:  P35670;
  ENSP ID: ENSP00000342559
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIESKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 7368 - protein, 1354 aa, Homo sapiens
  Payload ID: 1561;
  Gene Symbol: ATP7B;
  Gene Name: ATPase, Cu++ transporting, beta polypeptide;
  Uniprot ID:  P35670;
  ENSP ID: ENSP00000383217
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 7369 - protein, 1035 aa, Homo sapiens
  Payload ID: 1561;
  Gene Symbol: ATP7B;
  Gene Name: ATPase, Cu++ transporting, beta polypeptide;
  ENSP ID: ENSP00000383221
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 7370 - protein, 1400 aa, Homo sapiens
  Payload ID: 1561;
  Gene Symbol: ATP7B;
  Gene Name: ATPase, Cu++ transporting, beta polypeptide;
  ENSP ID: ENSP00000393343
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 7371 - protein, 1387 aa, Homo sapiens
  Payload ID: 1561;
  Gene Symbol: ATP7B;
  Gene Name: ATPase, Cu++ transporting, beta polypeptide;
  ENSP ID: ENSP00000416738
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 7372 - protein, 894 aa, Homo sapiens
  Payload ID: 1561;
  Gene Symbol: ATP7B;
  Gene Name: ATPase, Cu++ transporting, beta polypeptide;
  ENSP ID: ENSP00000489234
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPGGCWQMRTPTSTSPRQR

SEQ ID NO: 7373 - protein, 1417 aa, Homo sapiens
  Payload ID: 1561;
  Gene Symbol: ATP7B;
  Gene Name: ATPase, Cu++ transporting, beta polypeptide;
  ENSP ID: ENSP00000489398
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 7374 - protein, 42 aa, Homo sapiens
  Payload ID: 1561;
  Gene Symbol: ATP7B;
  Gene Name: ATPase, Cu++ transporting, beta polypeptide;
  ENSP ID: ENSP00000489512
  MOD_RES (1)..(1): Any amino acid
XEEIGFHASLAQRNPNAHHLDHKMEIKHSSVGGTSTFRPTNL

SEQ ID NO: 7375 - protein, 81 aa, Homo sapiens
  Payload ID: 1562;
  Gene Symbol: ATP6V0E2;
  Gene Name: ATPase, H+ transporting V0 subunit e2;
  Uniprot ID:  Q8NHE4;
  ENSP ID: ENSP00000396148
MTAHSFALPVIIFTTFWGLVGIAGPWFVPKGPNRGVIITMLVATAVCCYLFWLIAILAQLNPLFGPQLKNETIWYVRFLWE

SEQ ID NO: 7376 - protein, 130 aa, Homo sapiens
  Payload ID: 1562;
  Gene Symbol: ATP6V0E2;
  Gene Name: ATPase, H+ transporting V0 subunit e2;
  Uniprot ID:  Q8NHE4;
  ENSP ID: ENSP00000410220
MRVRGPARLIASGARLLLRMLSALPGWGPAHLQRPLLGPASCLGILRPAMTAHSFALPVIIFTTFWGLVGIAGPWFVPKGPNRGVIITMLVATAVCCYLFWLIAILAQLNPLFGPQLKNETIWYVRFLWE

SEQ ID NO: 7377 - protein, 213 aa, Homo sapiens
  Payload ID: 1562;
  Gene Symbol: ATP6V0E2;
  Gene Name: ATPase, H+ transporting V0 subunit e2;
  ENSP ID: ENSP00000411672
MRVRGPARLIASGARLLLRMLSALPGWGPAHLQRPLLGPASCLGILRPAMTAHSFALPVIIFTTFWGLVGIAGPWFVPKGPNRGVIITMLVATAVCCYLLCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGQMPGLSPS

SEQ ID NO: 7378 - protein, 187 aa, Homo sapiens
  Payload ID: 1562;
  Gene Symbol: ATP6V0E2;
  Gene Name: ATPase, H+ transporting V0 subunit e2;
  Uniprot ID:  Q8NHE4;
  ENSP ID: ENSP00000417939
MTAHSFALPVIIFTTFWGLVGIAGPWFVPKGPNRGVIITMLVATAVCCYLFWLIAILAQLNPLFGPQLKNETIWCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGQMPGLSPS

SEQ ID NO: 7379 - protein, 79 aa, Homo sapiens
  Payload ID: 1562;
  Gene Symbol: ATP6V0E2;
  Gene Name: ATPase, H+ transporting V0 subunit e2;
  ENSP ID: ENSP00000420012
MTAHSFALPVIIFTTFWGLVGIAGPWFVPKGPNRGVIITMLVATAVCCYLFFQAAPYTHEITTLEICTWEFLLFMNAPR

SEQ ID NO: 7380 - protein, 81 aa, Homo sapiens; identical to SEQ ID NO: 7375
  Payload ID: 1562;
  Gene Symbol: ATP6V0E2;
  Gene Name: ATPase, H+ transporting V0 subunit e2;
  Uniprot ID:  Q8NHE4;
  ENSP ID: ENSP00000420679

SEQ ID NO: 7381 - protein, 81 aa, Homo sapiens; identical to SEQ ID NO: 7375
  Payload ID: 1562;
  Gene Symbol: ATP6V0E2;
  Gene Name: ATPase, H+ transporting V0 subunit e2;
  Uniprot ID:  Q8NHE4;
  ENSP ID: ENSP00000475645

SEQ ID NO: 7382 - protein, 164 aa, Homo sapiens
  Payload ID: 1562;
  Gene Symbol: ATP6V0E2;
  Gene Name: ATPase, H+ transporting V0 subunit e2;
  Uniprot ID:  Q8NHE4;
  ENSP ID: ENSP00000475904
MTAHSFALPVIIFTTFWGLVGIAGPWFVPKGPNRGVIITMLVATAVCCYLLCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGQMPGLSPS

SEQ ID NO: 7383 - protein, 130 aa, Homo sapiens; identical to SEQ ID NO: 7376
  Payload ID: 1562;
  Gene Symbol: ATP6V0E2;
  Gene Name: ATPase, H+ transporting V0 subunit e2;
  Uniprot ID:  Q8NHE4;
  ENSP ID: ENSP00000481176

SEQ ID NO: 7384 - protein, 213 aa, Homo sapiens; identical to SEQ ID NO: 7377
  Payload ID: 1562;
  Gene Symbol: ATP6V0E2;
  Gene Name: ATPase, H+ transporting V0 subunit e2;
  ENSP ID: ENSP00000482231

SEQ ID NO: 7385 - protein, 118 aa, Homo sapiens
  Payload ID: 1563;
  Gene Symbol: ATP6V1G1;
  Gene Name: ATPase, H+ transporting, lysosomal 13kDa, V1 subunit G1;
  Uniprot ID:  O75348;
  ENSP ID: ENSP00000363162
MASQSQGIQQLLQAEKRAAEKVSEARKRKNRRLKQAKEEAQAEIEQYRLQREKEFKAKEAAALGSRGSCSTEVEKETQEKMTILQTYFRQNRDEVLDNLLAFVCDIRPEIHENYRING

SEQ ID NO: 7386 - protein, 118 aa, Homo sapiens
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000302194
MASQSQGIQQLLQAEKRAAEKVADARKRKARRLKQAKEEAQMEVEQYRREREHEFQSKQQAAMGSQGNLSAEVEQATRRQVQGMQSSQQRNRERVLAQLLGMVCDVRPQVHPNYRISA

SEQ ID NO: 7387 - protein, 78 aa, Homo sapiens
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000365321
MASQSQGIQQLLQAEKRAAEKVADARKRKARRLKQATRRQVQGMQSSQQRNRERVLAQLLGMVCDVRPQVHPNYRISA

SEQ ID NO: 7388 - protein, 118 aa, Homo sapiens; identical to SEQ ID NO: 7386
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000372995

SEQ ID NO: 7389 - protein, 158 aa, Homo sapiens
  Payload ID: 1564;
  Gene Symbol: ATP6V1G2;
  Gene Name: ATPase, H+ transporting, lysosomal 13kDa, V1 subunit G2;
  ENSP ID: ENSP00000390148
GGQQHAVPCPHGGPGGQGQPRAEAAGTGQGHRGGHRPGAVVGAAQHLHRGLGVAGGGPGPGPAVLQTRKARRLKQAKEEAQMEVEQYRREREHEFQSKQQAAMGSQGNLSAEVEQATRRQVQGMQSSQQRNRERVLAQLLGMVCDVRPQVHPNYRISA

SEQ ID NO: 7390 - protein, 118 aa, Homo sapiens; identical to SEQ ID NO: 7386
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000395436

SEQ ID NO: 7391 - protein, 78 aa, Homo sapiens; identical to SEQ ID NO: 7387
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000402430

SEQ ID NO: 7392 - protein, 78 aa, Homo sapiens; identical to SEQ ID NO: 7387
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000403158

SEQ ID NO: 7393 - protein, 118 aa, Homo sapiens; identical to SEQ ID NO: 7386
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000406372

SEQ ID NO: 7394 - protein, 118 aa, Homo sapiens; identical to SEQ ID NO: 7386
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000406389

SEQ ID NO: 7395 - protein, 78 aa, Homo sapiens; identical to SEQ ID NO: 7387
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000406575

SEQ ID NO: 7396 - protein, 78 aa, Homo sapiens; identical to SEQ ID NO: 7387
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000406668

SEQ ID NO: 7397 - protein, 118 aa, Homo sapiens; identical to SEQ ID NO: 7386
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000408670

SEQ ID NO: 7398 - protein, 78 aa, Homo sapiens; identical to SEQ ID NO: 7387
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000409104

SEQ ID NO: 7399 - protein, 118 aa, Homo sapiens; identical to SEQ ID NO: 7386
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000413222

SEQ ID NO: 7400 - protein, 78 aa, Homo sapiens; identical to SEQ ID NO: 7387
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000416031

SEQ ID NO: 7401 - protein, 77 aa, Homo sapiens
  Payload ID: 1564;
  Gene Symbol: ATP6V1G2;
  Gene Name: ATPase, H+ transporting, lysosomal 13kDa, V1 subunit G2;
  Uniprot ID:  O95670;
  ENSP ID: ENSP00000419698
MEVEQYRREREHEFQSKQQAAMGSQGNLSAEVEQATRRQVQGMQSSQQRNRERVLAQLLGMVCDVRPQVHPNYRISA

SEQ ID NO: 7402 - protein, 118 aa, Homo sapiens
  Payload ID: 1565;
  Gene Symbol: ATP6V1G3;
  Gene Name: ATPase, H+ transporting, lysosomal 13kDa, V1 subunit G3;
  Uniprot ID:  Q96LB4;
  ENSP ID: ENSP00000281087
MTSQSQGIHQLLQAEKRAKDKLEEAKKRKGKRLKQAKEEAMVEIDQYRMQRDKEFRLKQSKIMGSQNNLSDEIEEQTLGKIQELNGHYNKYMESVMNQLLSMVCDMKPEIHVNYRATN

SEQ ID NO: 7403 - protein, 59 aa, Homo sapiens
  Payload ID: 1565;
  Gene Symbol: ATP6V1G3;
  Gene Name: ATPase, H+ transporting, lysosomal 13kDa, V1 subunit G3;
  Uniprot ID:  Q96LB4;
  ENSP ID: ENSP00000309574
MTSQSQGIHQLLQAEKRAKDKLEEAKKILHLLFLKRRDWDCFWKRKAIEASQGGSNGRN

SEQ ID NO: 7404 - protein, 118 aa, Homo sapiens; identical to SEQ ID NO: 7402
  Payload ID: 1565;
  Gene Symbol: ATP6V1G3;
  Gene Name: ATPase, H+ transporting, lysosomal 13kDa, V1 subunit G3;
  Uniprot ID:  Q96LB4;
  ENSP ID: ENSP00000356351

SEQ ID NO: 7405 - protein, 118 aa, Homo sapiens; identical to SEQ ID NO: 7402
  Payload ID: 1565;
  Gene Symbol: ATP6V1G3;
  Gene Name: ATPase, H+ transporting, lysosomal 13kDa, V1 subunit G3;
  Uniprot ID:  Q96LB4;
  ENSP ID: ENSP00000356352

SEQ ID NO: 7406 - protein, 124 aa, Homo sapiens
  Payload ID: 1565;
  Gene Symbol: ATP6V1G3;
  Gene Name: ATPase, H+ transporting, lysosomal 13kDa, V1 subunit G3;
  Uniprot ID:  Q96LB4;
  ENSP ID: ENSP00000417171
MTSQSQGIHQLLQAEKRAKDKLEEAKKKTGTASGKGKRLKQAKEEAMVEIDQYRMQRDKEFRLKQSKIMGSQNNLSDEIEEQTLGKIQELNGHYNKYMESVMNQLLSMVCDMKPEIHVNYRATN

SEQ ID NO: 7407 - protein, 124 aa, Homo sapiens; identical to SEQ ID NO: 7406
  Payload ID: 1565;
  Gene Symbol: ATP6V1G3;
  Gene Name: ATPase, H+ transporting, lysosomal 13kDa, V1 subunit G3;
  Uniprot ID:  Q96LB4;
  ENSP ID: ENSP00000461228

SEQ ID NO: 7408 - protein, 118 aa, Homo sapiens; identical to SEQ ID NO: 7402
  Payload ID: 1565;
  Gene Symbol: ATP6V1G3;
  Gene Name: ATPase, H+ transporting, lysosomal 13kDa, V1 subunit G3;
  Uniprot ID:  Q96LB4;
  ENSP ID: ENSP00000461329

SEQ ID NO: 7409 - protein, 59 aa, Homo sapiens; identical to SEQ ID NO: 7403
  Payload ID: 1565;
  Gene Symbol: ATP6V1G3;
  Gene Name: ATPase, H+ transporting, lysosomal 13kDa, V1 subunit G3;
  Uniprot ID:  Q96LB4;
  ENSP ID: ENSP00000461616

SEQ ID NO: 7410 - protein, 119 aa, Homo sapiens
  Payload ID: 1566;
  Gene Symbol: ATP6V1F;
  Gene Name: ATPase, H+ transporting, lysosomal 14kDa, V1 subunit F;
  Uniprot ID:  Q16864;
  ENSP ID: ENSP00000249289
MAGRGKLIAVIGDEDTVTGFLLGGIGELNKNRHPNFLVVEKDTTINEIEDTFRQFLNRDDIGIILINQYIAEMVRHALDAHQQSIPAVLEIPSKEHPYDAAKDSILRRARGMFTAEDLR

SEQ ID NO: 7411 - protein, 147 aa, Homo sapiens
  Payload ID: 1566;
  Gene Symbol: ATP6V1F;
  Gene Name: ATPase, H+ transporting, lysosomal 14kDa, V1 subunit F;
  Uniprot ID:  Q16864;
  ENSP ID: ENSP00000417378
MAGRGKLIAVIGDEDTVTGFLLGGIGELNKNRHPNFLVVEKDTTINEIEDTFRSLGSLPGSVVEANPNQRDPPLWDEIDSRQFLNRDDIGIILINQYIAEMVRHALDAHQQSIPAVLEIPSKEHPYDAAKDSILRRARGMFTAEDLR

SEQ ID NO: 7412 - protein, 155 aa, Homo sapiens
  Payload ID: 1567;
  Gene Symbol: ATP6V0C;
  Gene Name: ATPase, H+ transporting, lysosomal 16kDa, V0 subunit c;
  Uniprot ID:  P27449;
  ENSP ID: ENSP00000329757
MSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 7413 - protein, 63 aa, Homo sapiens
  Payload ID: 1567;
  Gene Symbol: ATP6V0C;
  Gene Name: ATPase, H+ transporting, lysosomal 16kDa, V0 subunit c;
  ENSP ID: ENSP00000454597
MSESKSGPDPGRCLWHSQERYRHCGHVCHAAGADHEVHHPSGHGWHHRHLRPGGGSPHRQLPE

SEQ ID NO: 7414 - protein, 112 aa, Homo sapiens
  Payload ID: 1567;
  Gene Symbol: ATP6V0C;
  Gene Name: ATPase, H+ transporting, lysosomal 16kDa, V0 subunit c;
  ENSP ID: ENSP00000454868
MSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 7415 - protein, 112 aa, Homo sapiens; identical to SEQ ID NO: 7414
  Payload ID: 1567;
  Gene Symbol: ATP6V0C;
  Gene Name: ATPase, H+ transporting, lysosomal 16kDa, V0 subunit c;
  ENSP ID: ENSP00000457782

SEQ ID NO: 7416 - protein, 158 aa, Homo sapiens
  Payload ID: 1568;
  Gene Symbol: ATP6V0B;
  Gene Name: ATPase, H+ transporting, lysosomal 21kDa, V0 subunit b;
  Uniprot ID:  Q99437;
  ENSP ID: ENSP00000236067
MWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 7417 - protein, 88 aa, Homo sapiens
  Payload ID: 1568;
  Gene Symbol: ATP6V0B;
  Gene Name: ATPase, H+ transporting, lysosomal 21kDa, V0 subunit b;
  ENSP ID: ENSP00000431375
  MOD_RES (1)..(1): Any amino acid
XAVGEAGSWRAGAASRPSWPGRNSAGKWPAGNTGPPRALHPRLWGLAPARASDSDKGDPDFQLLEEGCGRESATPFLIWASALMWHGS

SEQ ID NO: 7418 - protein, 205 aa, Homo sapiens
  Payload ID: 1568;
  Gene Symbol: ATP6V0B;
  Gene Name: ATPase, H+ transporting, lysosomal 21kDa, V0 subunit b;
  Uniprot ID:  Q99437;
  ENSP ID: ENSP00000431605
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 7419 - protein, 252 aa, Homo sapiens
  Payload ID: 1568;
  Gene Symbol: ATP6V0B;
  Gene Name: ATPase, H+ transporting, lysosomal 21kDa, V0 subunit b;
  ENSP ID: ENSP00000432754
MTGLALLYSGVFVAFWACALAVGEAGSWRAGAASRPSWPGRNSAGKWPAGNTGPPRALHPRLWGLAPARASDSDKGDPDFQLLEEGFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 7420 - protein, 86 aa, Homo sapiens
  Payload ID: 1568;
  Gene Symbol: ATP6V0B;
  Gene Name: ATPase, H+ transporting, lysosomal 21kDa, V0 subunit b;
  ENSP ID: ENSP00000432994
MWSNLGIGLAISLSVVGAAWGIYITGSSIIGGGVKAPRIKTKNLVSIIFCEAVAIYGIIMAIVISNMAEPFSATDPKAIGHRNYHA

SEQ ID NO: 7421 - protein, 158 aa, Homo sapiens; identical to SEQ ID NO: 7416
  Payload ID: 1568;
  Gene Symbol: ATP6V0B;
  Gene Name: ATPase, H+ transporting, lysosomal 21kDa, V0 subunit b;
  Uniprot ID:  Q99437;
  ENSP ID: ENSP00000434094

SEQ ID NO: 7422 - protein, 261 aa, Homo sapiens
  Payload ID: 1568;
  Gene Symbol: ATP6V0B;
  Gene Name: ATPase, H+ transporting, lysosomal 21kDa, V0 subunit b;
  ENSP ID: ENSP00000434729
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQVMNPLGKPLCPCPQPSLTLLLEKLKCSPSLPITIDSPKQLPPPHFHLLVFSYRGSLFLSLIWCH

SEQ ID NO: 7423 - protein, 46 aa, Homo sapiens
  Payload ID: 1568;
  Gene Symbol: ATP6V0B;
  Gene Name: ATPase, H+ transporting, lysosomal 21kDa, V0 subunit b;
  ENSP ID: ENSP00000435396
MTGLALLYSGVFVAFWACALAVAVLSPGGSLRTPLQGGGPSARQLL

SEQ ID NO: 7424 - protein, 226 aa, Homo sapiens
  Payload ID: 1569;
  Gene Symbol: ATP6V1E1;
  Gene Name: ATPase, H+ transporting, lysosomal 31kDa, V1 subunit E1;
  Uniprot ID:  P36543;
  ENSP ID: ENSP00000253413
MALSDADVQKQIKHMMAFIEQEANEKAEEIDAKAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 7425 - protein, 196 aa, Homo sapiens
  Payload ID: 1569;
  Gene Symbol: ATP6V1E1;
  Gene Name: ATPase, H+ transporting, lysosomal 31kDa, V1 subunit E1;
  Uniprot ID:  P36543;
  ENSP ID: ENSP00000382694
MALSDADVQKQIKHMMAFIEQEANEKAEEIDAKAEEEFNIEKGRLVQTQRLKIMEYYEKKEKQIEQQKKIQMSNLMNQARLKVLRARDDLITGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 7426 - protein, 204 aa, Homo sapiens
  Payload ID: 1569;
  Gene Symbol: ATP6V1E1;
  Gene Name: ATPase, H+ transporting, lysosomal 31kDa, V1 subunit E1;
  Uniprot ID:  P36543;
  ENSP ID: ENSP00000382696
MALSDADVQKQAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGVEIYNGDRKIKVSNTLESRLDLIAQQMMPEVRGALFGANANRKFLD

SEQ ID NO: 7427 - protein, 203 aa, Homo sapiens
  Payload ID: 1569;
  Gene Symbol: ATP6V1E1;
  Gene Name: ATPase, H+ transporting, lysosomal 31kDa, V1 subunit E1;
  ENSP ID: ENSP00000398932
MQSRDGVSPCWPGWSQSLDLVIRLPRPPQVLGLQAEEEFNIEKGRLVQTQRLKIMEYYEKKEKQIEQQKKIQMSNLMNQARLKVLRARDDLITDLLNEAKQRLSKVVKDTTRYQVLLDGLVLQGLYQLLEPRMIVRCRKQDFPLVKAAVQKAIPMYKIATKNDVDVQIDQESYLPEDIAGGVEIYNGDRKIKVSNTLESRLDL

SEQ ID NO: 7428 - protein, 226 aa, Homo sapiens
  Payload ID: 1570;
  Gene Symbol: ATP6V1E2;
  Gene Name: ATPase, H+ transporting, lysosomal 31kDa, V1 subunit E2;
  Uniprot ID:  Q96A05;
  ENSP ID: ENSP00000304891
MALSDVDVKKQIKHMMAFIEQEANEKAEEIDAKAEEEFNIEKGRLVQTQRLKIMEYYEKKEKQIEQQKKILMSTMRNQARLKVLRARNDLISDLLSEAKLRLSRIVEDPEVYQGLLDKLVLQGLLRLLEPVMIVRCRPQDLLLVEAAVQKAIPEYMTISQKHVEVQIDKEAYLAVNAAGGVEVYSGNQRIKVSNTLESRLDLSAKQKMPEIRMALFGANTNRKFFI

SEQ ID NO: 7429 - protein, 226 aa, Homo sapiens; identical to SEQ ID NO: 7428
  Payload ID: 1570;
  Gene Symbol: ATP6V1E2;
  Gene Name: ATPase, H+ transporting, lysosomal 31kDa, V1 subunit E2;
  Uniprot ID:  Q96A05;
  ENSP ID: ENSP00000428141

SEQ ID NO: 7430 - protein, 247 aa, Homo sapiens
  Payload ID: 1571;
  Gene Symbol: ATP6V1D;
  Gene Name: ATPase, H+ transporting, lysosomal 34kDa, V1 subunit D;
  Uniprot ID:  Q9Y5K8;
  ENSP ID: ENSP00000216442
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLKKIQEKKKILKEKSEKDLEQRRAAGEVLEPANLLAEEKDEDLLFE

SEQ ID NO: 7431 - protein, 44 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000450834
VMREAAFSLAEAKFTAGDFSTTVIQNVNKAQVKIRAKKDNVAAC

SEQ ID NO: 7432 - protein, 192 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000450841
MLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLKKIQEKKKILKEKSEKDLEQRRAAGEVLEPANLLAEEKDEDLLFE

SEQ ID NO: 7433 - protein, 148 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000450885
MSGKDRIEIFPSRMAQTIMKARLKGAQTGRNLLKKKSDALTLRFRQILKKIIETSFVTLDEAIKITNRRVNAIEHVIIPRIERTLAYIITELDEREREEFYRLKKIQEKKKILKEKSEKDLEQRRAAGEVLEPANLLAEEKDEDLLFE

SEQ ID NO: 7434 - protein, 72 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000451031
MSGKDRIEIFPSRMAQTIMKARLKGAQTGRNLLKKKSDALTLRFRQILKKIIETKMLMGEVMREAAFSLAEA

SEQ ID NO: 7435 - protein, 247 aa, Homo sapiens; identical to SEQ ID NO: 7430
  Payload ID: 1571;
  Gene Symbol: ATP6V1D;
  Gene Name: ATPase, H+ transporting, lysosomal 34kDa, V1 subunit D;
  Uniprot ID:  Q9Y5K8;
  ENSP ID: ENSP00000451167

SEQ ID NO: 7436 - protein, 86 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000451422
MSGKDRIEIFPSRMAQTIMKARLKGAQTGRNLLKKKSDALTLRFRQILKKIIETKMLMGEVMREAAFSLAEAKFTAGDFRCYFASI

SEQ ID NO: 7437 - protein, 153 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000451564
RAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLKKIQEKKKILKEKSEKDLEQRRAAGEVLEPANLLAEEKDEDLLFE

SEQ ID NO: 7438 - protein, 119 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000452029
KKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQVKENTREEKDSKGKI

SEQ ID NO: 7439 - protein, 179 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000452192
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQSSFPGLNVLLLISSQSWMRESEKSSIG

SEQ ID NO: 7440 - protein, 59 aa, Homo sapiens
  Payload ID: 1571;
  Gene Symbol: ATP6V1D;
  Gene Name: ATPase, H+ transporting, lysosomal 34kDa, V1 subunit D;
  ENSP ID: ENSP00000452492
MKARLKGAQTGRNLLKKKSDALTLRFRQILKKIIETKMLMGEVMREAAFSLAEAKFTAG

SEQ ID NO: 7441 - protein, 351 aa, Homo sapiens
  Payload ID: 1572;
  Gene Symbol: ATP6V0D1;
  Gene Name: ATPase, H+ transporting, lysosomal 38kDa, V0 subunit d1;
  Uniprot ID:  P61421;
  ENSP ID: ENSP00000290949
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 7442 - protein, 58 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000393910
  MOD_RES (1)..(1): Any amino acid
XSCTSRASLSGSLWTSLEHLLEQRSQEGHSGQQVALLDQSRAEEWMVPQGMPEGLVPE

SEQ ID NO: 7443 - protein, 392 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000441282
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITQESEAGTPEGPGNMPKLGSRPSPGHRPPFLRVSLLPWPPSSYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 7444 - protein, 71 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000455446
  MOD_RES (1)..(1): Any amino acid
XLEHLLEQRSQEGHSGQQVALLDQSRAEVMLGLRARGLTGCGGEAELQLQGYMDCWVKVTANHSIWRTSFW

SEQ ID NO: 7445 - protein, 113 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000455695
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITGFFPGLHFRAGP

SEQ ID NO: 7446 - protein, 227 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000455802
  MOD_RES (1)..(1): Any amino acid
XLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILESCPKRTVPSSFHTVGGSTLRAWRSWLGLTTMNRSRTWPITTRSTSCSSRVQVATLET

SEQ ID NO: 7447 - protein, 115 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000456695
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITCLTLTLEEFPLGLI

SEQ ID NO: 7448 - protein, 40 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000457104
  MOD_RES (1)..(1): Any amino acid
XHFKGFSLRQPVDFPGALAGAEITGRSLWPASSTVRPVKG

SEQ ID NO: 7449 - protein, 57 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000457105
MSFFPELYFNVDNGYLEGLVRGLKAGVLSQADYLNLVQCETLEGMDGATRDARGTCP

SEQ ID NO: 7450 - protein, 47 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000457744
MSFFPELYFNVDNGYLEGLVRGLKAGVLSQADYLNLVQCETLEVTVT

SEQ ID NO: 7451 - protein, 232 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000463328
  MOD_RES (1)..(1): Any amino acid
XFPELYFNVDNGYLEGLVRGLKAGVLSQADYLNLVQCETLEAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 7452 - protein, 274 aa, Homo sapiens
  Payload ID: 1572;
  Gene Symbol: ATP6V0D1;
  Gene Name: ATPase, H+ transporting, lysosomal 38kDa, V0 subunit d1;
  ENSP ID: ENSP00000473515
MVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 7453 - protein, 350 aa, Homo sapiens
  Payload ID: 1573;
  Gene Symbol: ATP6V0D2;
  Gene Name: ATPase, H+ transporting, lysosomal 38kDa, V0 subunit d2;
  Uniprot ID:  Q8N8Y2;
  ENSP ID: ENSP00000285393
MLEGAELYFNVDHGYLEGLVRGCKASLLTQQDYINLVQCETLEDLKIHLQTTDYGNFLANHTNPLTVSKIDTEMRKRLCGEFEYFRNHSLEPLSTFLTYMTCSYMIDNVILLMNGALQKKSVKEILGKCHPLGRFTEMEAVNIAETPSDLFNAILIETPLAPFFQDCMSENALDELNIELLRNKLYKSYLEAFYKFCKNHGDVTAEVMCPILEFEADRRAFIITLNSFGTELSKEDRETLYPTFGKLYPEGLRLLAQAEDFDQMKNVADHYGVYKPLFEAVGGSGGKTLEDVFYEREVQMNVLAFNRQFHYGVFYAYVKLKEQEIRNIVWIAECISQRHRTKINSYIPIL

SEQ ID NO: 7454 - protein, 43 aa, Homo sapiens
  Payload ID: 1573;
  Gene Symbol: ATP6V0D2;
  Gene Name: ATPase, H+ transporting, lysosomal 38kDa, V0 subunit d2;
  ENSP ID: ENSP00000428382
MLEGAELYFNVDHGYLEGLVRGCKASLLTQQDYINLVQCETLE

SEQ ID NO: 7455 - protein, 36 aa, Homo sapiens
  Payload ID: 1573;
  Gene Symbol: ATP6V0D2;
  Gene Name: ATPase, H+ transporting, lysosomal 38kDa, V0 subunit d2;
  ENSP ID: ENSP00000429731
MLEGAELYFNVDHGYLEGLVRGCKASLLTQQDYINL

SEQ ID NO: 7456 - protein, 382 aa, Homo sapiens
  Payload ID: 1574;
  Gene Symbol: ATP6V1C1;
  Gene Name: ATPase, H+ transporting, lysosomal 42kDa, V1 subunit C1;
  Uniprot ID:  P21283;
  ENSP ID: ENSP00000379203
MTEFWLISAPGEKTCQQTWEKLHAATSKNNNLAVTSKFNIPDLKVGTLDVLVGLSDELAKLDAFVEGVVKKVAQYMADVLEDSKDKVQENLLANGVDLVTYITRFQWDMAKYPIKQSLKNISEIIAKGVTQIDNDLKSRASAYNNLKGNLQNLERKNAGSLLTRSLAEIVKKDDFVLDSEYLVTLLVVVPKLNHNDWIKQYETLAEMVVPRSSNVLSEDQDSYLCNVTLFRKAVDDFRHKARENKFIVRDFQYNEEEMKADKEEMNRLSTDKKKQFGPLVRWLKVNFSEAFIAWIHVKALRVFVESVLRYGLPVNFQAMLLQPNKKTLKKLREVLHELYKHLDSSAAAIIDAPMDIPGLNLSQQEYYPYVYYKIDCNLLEFK

SEQ ID NO: 7457 - protein, 307 aa, Homo sapiens
  Payload ID: 1574;
  Gene Symbol: ATP6V1C1;
  Gene Name: ATPase, H+ transporting, lysosomal 42kDa, V1 subunit C1;
  ENSP ID: ENSP00000428204
MADVLEDSKDKVQENLLANGVDLVTYITRFQWDMAKYPIKQSLKNISEIIAKGVTQIDNDLKSRASAYNNLKGNLQNLERKNAGSLLTRSLAEIVKKDDFVLDSEYLVTLLVVVPKLNHNDWIKQYETLAEMVVPRSSNVLSEDQDSYLCNVTLFRKAVDDFRHKARENKFIVRDFQYNEEEMKADKEEMNRLSTDKKKQFGPLVRWLKVNFSEAFIAWIHVKALRVFVESVLRYGLPVNFQAMLLQPNKKTLKKLREVLHELYKHLDSSAAAIIDAPMDIPGLNLSQQEYYPYVYYKIDCNLLEFK

SEQ ID NO: 7458 - protein, 307 aa, Homo sapiens; identical to SEQ ID NO: 7457
  Payload ID: 1574;
  Gene Symbol: ATP6V1C1;
  Gene Name: ATPase, H+ transporting, lysosomal 42kDa, V1 subunit C1;
  ENSP ID: ENSP00000430129

SEQ ID NO: 7459 - protein, 382 aa, Homo sapiens; identical to SEQ ID NO: 7456
  Payload ID: 1574;
  Gene Symbol: ATP6V1C1;
  Gene Name: ATPase, H+ transporting, lysosomal 42kDa, V1 subunit C1;
  Uniprot ID:  P21283;
  ENSP ID: ENSP00000430282

SEQ ID NO: 7460 - protein, 427 aa, Homo sapiens
  Payload ID: 1575;
  Gene Symbol: ATP6V1C2;
  Gene Name: ATPase, H+ transporting, lysosomal 42kDa, V1 subunit C2;
  Uniprot ID:  Q8NEY4;
  ENSP ID: ENSP00000272238
MSEFWLISAPGDKENLQALERMNTVTSKSNLSYNTKFAIPDFKVGTLDSLVGLSDELGKLDTFAESLIRRMAQSVVEVMEDSKGKVQEHLLANGVDLTSFVTHFEWDMAKYPVKQPLVSVVDTIAKQLAQIEMDLKSRTAAYNTLKTNLENLEKKSMGNLFTRTLSDIVSKEDFVLDSEYLVTLLVIVPKPNYSQWQKTYESLSDMVVPRSTKLITEDKEGGLFTVTLFRKVIEDFKTKAKENKFTVREFYYDEKEIEREREEMARLLSDKKQQYQTSCVALKKGSSTFPDHKVKVTPLGNPDRPAAGQTDRERESEGEGEGPLLRWLKVNFSEAFIAWIHIKALRVFVESVLRYGLPVNFQAVLLQPHKKSSTKRLREVLNSVFRHLDEVAATSILDASVEIPGLQLNNQDYFPYVYFHIDLSLLD

SEQ ID NO: 7461 - protein, 381 aa, Homo sapiens
  Payload ID: 1575;
  Gene Symbol: ATP6V1C2;
  Gene Name: ATPase, H+ transporting, lysosomal 42kDa, V1 subunit C2;
  Uniprot ID:  Q8NEY4;
  ENSP ID: ENSP00000371077
MSEFWLISAPGDKENLQALERMNTVTSKSNLSYNTKFAIPDFKVGTLDSLVGLSDELGKLDTFAESLIRRMAQSVVEVMEDSKGKVQEHLLANGVDLTSFVTHFEWDMAKYPVKQPLVSVVDTIAKQLAQIEMDLKSRTAAYNTLKTNLENLEKKSMGNLFTRTLSDIVSKEDFVLDSEYLVTLLVIVPKPNYSQWQKTYESLSDMVVPRSTKLITEDKEGGLFTVTLFRKVIEDFKTKAKENKFTVREFYYDEKEIEREREEMARLLSDKKQQYGPLLRWLKVNFSEAFIAWIHIKALRVFVESVLRYGLPVNFQAVLLQPHKKSSTKRLREVLNSVFRHLDEVAATSILDASVEIPGLQLNNQDYFPYVYFHIDLSLLD

SEQ ID NO: 7462 - protein, 437 aa, Homo sapiens
  Payload ID: 1575;
  Gene Symbol: ATP6V1C2;
  Gene Name: ATPase, H+ transporting, lysosomal 42kDa, V1 subunit C2;
  ENSP ID: ENSP00000489280
MSEFWLISAPGDKENLQALERMNTVTSKSNLSYNTKFAIPDFKVGTLDSLVGLSDELGKLDTFAESLIRRMAQSVVEVMEDSKGKVQEHLLANGGLKGKMKCLKIDLTSFVTHFEWDMAKYPVKQPLVSVVDTIAKQLAQIEMDLKSRTAAYNTLKTNLENLEKKSMGNLFTRTLSDIVSKEDFVLDSEYLVTLLVIVPKPNYSQWQKTYESLSDMVVPRSTKLITEDKEGGLFTVTLFRKVIEDFKTKAKENKFTVREFYYDEKEIEREREEMARLLSDKKQQYQTSCVALKKGSSTFPDHKVKVTPLGNPDRPAAGQTDRERESEGEGEGPLLRWLKVNFSEAFIAWIHIKALRVFVESVLRYGLPVNFQAVLLQPHKKSSTKRLREVLNSVFRHLDEVAATSILDASVEIPGLQLNNQDYFPYVYFHIDLSLLD

SEQ ID NO: 7463 - protein, 465 aa, Homo sapiens
  Payload ID: 1576;
  Gene Symbol: ATP6V1H;
  Gene Name: ATPase, H+ transporting, lysosomal 50/57kDa, V1 subunit H;
  Uniprot ID:  Q9UI12;
  ENSP ID: ENSP00000347359
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 7464 - protein, 483 aa, Homo sapiens
  Payload ID: 1576;
  Gene Symbol: ATP6V1H;
  Gene Name: ATPase, H+ transporting, lysosomal 50/57kDa, V1 subunit H;
  Uniprot ID:  Q9UI12;
  ENSP ID: ENSP00000352522
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQKLRGSGVAVETGTVSSSDSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 7465 - protein, 483 aa, Homo sapiens; identical to SEQ ID NO: 7464
  Payload ID: 1576;
  Gene Symbol: ATP6V1H;
  Gene Name: ATPase, H+ transporting, lysosomal 50/57kDa, V1 subunit H;
  Uniprot ID:  Q9UI12;
  ENSP ID: ENSP00000379995

SEQ ID NO: 7466 - protein, 101 aa, Homo sapiens
  Payload ID: 1576;
  Gene Symbol: ATP6V1H;
  Gene Name: ATPase, H+ transporting, lysosomal 50/57kDa, V1 subunit H;
  ENSP ID: ENSP00000427835
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDML

SEQ ID NO: 7467 - protein, 48 aa, Homo sapiens
  Payload ID: 1576;
  Gene Symbol: ATP6V1H;
  Gene Name: ATPase, H+ transporting, lysosomal 50/57kDa, V1 subunit H;
  ENSP ID: ENSP00000428255
MTKMDIRGAVDAAVPTNIIAAKAAEVRANKVNWQSYLQGQMISAEDLC

SEQ ID NO: 7468 - protein, 86 aa, Homo sapiens
  Payload ID: 1576;
  Gene Symbol: ATP6V1H;
  Gene Name: ATPase, H+ transporting, lysosomal 50/57kDa, V1 subunit H;
  ENSP ID: ENSP00000428625
FDYARCSKNTAWPYFLPMLNRQDPFTVHMAARIIAKLAAWGKELMEGSDLNYYFNWIKTQLSSQKLRGSGVAVETGTVSSSDHSIQ

SEQ ID NO: 7469 - protein, 36 aa, Homo sapiens
  Payload ID: 1576;
  Gene Symbol: ATP6V1H;
  Gene Name: ATPase, H+ transporting, lysosomal 50/57kDa, V1 subunit H;
  ENSP ID: ENSP00000428969
MTKMDIRGAVDAAVPTNIIAAKRCFKLKAASVLKHL

SEQ ID NO: 7470 - protein, 102 aa, Homo sapiens
  Payload ID: 1576;
  Gene Symbol: ATP6V1H;
  Gene Name: ATPase, H+ transporting, lysosomal 50/57kDa, V1 subunit H;
  ENSP ID: ENSP00000429786
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQ

SEQ ID NO: 7471 - protein, 443 aa, Homo sapiens
  Payload ID: 1576;
  Gene Symbol: ATP6V1H;
  Gene Name: ATPase, H+ transporting, lysosomal 50/57kDa, V1 subunit H;
  ENSP ID: ENSP00000429947
MISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQKLRGSGVAVETGTVSSSDSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 7472 - protein, 48 aa, Homo sapiens
  Payload ID: 1576;
  Gene Symbol: ATP6V1H;
  Gene Name: ATPase, H+ transporting, lysosomal 50/57kDa, V1 subunit H;
  ENSP ID: ENSP00000487194
MTKMDIRGAVDAAVPTNIIAAKAAEVRANKVNWQSYLQGQMISAEDFC

SEQ ID NO: 7473 - protein, 513 aa, Homo sapiens
  Payload ID: 1577;
  Gene Symbol: ATP6V1B1;
  Gene Name: ATPase, H+ transporting, lysosomal 56/58kDa, V1 subunit B1;
  Uniprot ID:  P15313;
  ENSP ID: ENSP00000234396
MAMEIDSRPGGLPGSSCNLGAAREHMQAVTRNYITHPRVTYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVNMETARFFKSDFEQNGTMGNVCLFLNLANDPTIERIITPRLALTTAEFLAYQCEKHVLVILTDMSSYAEALREVSAAREEVPGRRGFPGYMYTDLATIYERAGRVEGRGGSITQIPILTMPNDDITHPIPDLTGFITEGQIYVDRQLHNRQIYPPINVLPSLSRLMKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 7474 - protein, 74 aa, Homo sapiens
  Payload ID: 1577;
  Gene Symbol: ATP6V1B1;
  Gene Name: ATPase, H+ transporting, lysosomal 56/58kDa, V1 subunit B1;
  ENSP ID: ENSP00000387599
MLGRVFNGSGKPIDKGPVVMAEDFLDINGQPINPHSRIYPEEMIQTGISPIDVMNSIARGQKIPIFSAAGLPHN

SEQ ID NO: 7475 - protein, 496 aa, Homo sapiens
  Payload ID: 1577;
  Gene Symbol: ATP6V1B1;
  Gene Name: ATPase, H+ transporting, lysosomal 56/58kDa, V1 subunit B1;
  ENSP ID: ENSP00000388353
MAMEIDSRPGGLPGSSCNLGAAREHMQAVTRNYITHPRVTYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVNMETARFFKSDFEQNGTMGNVCLFLNLANDPTIERIITPRLALTTAEFLAYQCEKHVLVILTDMSSYAEALREVSAAREEVPGRRGFPGYMYTDLATIYERAGRVEDITHPIPDLTGFITEGQIYVDRQLHNRQIYPPINVLPSLSRLMKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 7476 - protein, 248 aa, Homo sapiens
  Payload ID: 1577;
  Gene Symbol: ATP6V1B1;
  Gene Name: ATPase, H+ transporting, lysosomal 56/58kDa, V1 subunit B1;
  ENSP ID: ENSP00000405114
MAMEIDSRPGGLPGSSCNLGAAREHMQAVTRNYITHPRVTYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVRRLSRLASEHGDSQILQV

SEQ ID NO: 7477 - protein, 118 aa, Homo sapiens
  Payload ID: 1577;
  Gene Symbol: ATP6V1B1;
  Gene Name: ATPase, H+ transporting, lysosomal 56/58kDa, V1 subunit B1;
  ENSP ID: ENSP00000407840
MKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 7478 - protein, 249 aa, Homo sapiens
  Payload ID: 1577;
  Gene Symbol: ATP6V1B1;
  Gene Name: ATPase, H+ transporting, lysosomal 56/58kDa, V1 subunit B1;
  ENSP ID: ENSP00000408361
MTLTAMVAGPVTANDPDGPGWEGGGVWREEGKAEDASVCVSRVFGVRPLLTPAPPPAYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVRR

SEQ ID NO: 7479 - protein, 511 aa, Homo sapiens
  Payload ID: 1578;
  Gene Symbol: ATP6V1B2;
  Gene Name: ATPase, H+ transporting, lysosomal 56/58kDa, V1 subunit B2;
  Uniprot ID:  P21281;
  ENSP ID: ENSP00000276390
MALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 7480 - protein, 56 aa, Homo sapiens
  Payload ID: 1578;
  Gene Symbol: ATP6V1B2;
  Gene Name: ATPase, H+ transporting, lysosomal 56/58kDa, V1 subunit B2;
  ENSP ID: ENSP00000428069
  MOD_RES (1)..(1): Any amino acid
XRGIVNGAAPELPVPTGGPAVGAREQALAVSRNYLSQPRLSYTISPISFVTFVTSA

SEQ ID NO: 7481 - protein, 66 aa, Homo sapiens
  Payload ID: 1578;
  Gene Symbol: ATP6V1B2;
  Gene Name: ATPase, H+ transporting, lysosomal 56/58kDa, V1 subunit B2;
  ENSP ID: ENSP00000430154
MALRAMRGIVNGAAPELPVPTGGPAVGAREQALAVSRNYLSQPRLTYKTVSGVNGPLVILDHVKVC

SEQ ID NO: 7482 - protein, 199 aa, Homo sapiens
  Payload ID: 1578;
  Gene Symbol: ATP6V1B2;
  Gene Name: ATPase, H+ transporting, lysosomal 56/58kDa, V1 subunit B2;
  ENSP ID: ENSP00000430682
  MOD_RES (1)..(1): Any amino acid
XGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEVRTGIGLL

SEQ ID NO: 7483 - protein, 49 aa, Homo sapiens
  Payload ID: 1578;
  Gene Symbol: ATP6V1B2;
  Gene Name: ATPase, H+ transporting, lysosomal 56/58kDa, V1 subunit B2;
  ENSP ID: ENSP00000430866
  MOD_RES (1)..(1): Any amino acid
XQAMKAVVGEEALTSDDLLYLEFLQKFERNFIAQGVSLCRPGWSTVVRS

SEQ ID NO: 7484 - protein, 617 aa, Homo sapiens
  Payload ID: 1579;
  Gene Symbol: ATP6V1A;
  Gene Name: ATPase, H+ transporting, lysosomal 70kDa, V1 subunit A;
  Uniprot ID:  P38606;
  ENSP ID: ENSP00000273398
MDFSKLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKLPANHPLLTGQRVLDALFPCVQGGTTAIPGAFGCGKTVISQSLSKYSNSDVIIYVGCGERGNEMSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKASLAETDKITLEVAKLIKDDFLQQNGYTPYDRFCPFYKTVGMLSNMIAFYDMARRAVETTAQSDNKITWSIIREHMGDILYKLSSMKFKDPLKDGEAKIKSDYAQLLEDMQNAFRSLED

SEQ ID NO: 7485 - protein, 184 aa, Homo sapiens
  Payload ID: 1579;
  Gene Symbol: ATP6V1A;
  Gene Name: ATPase, H+ transporting, lysosomal 70kDa, V1 subunit A;
  ENSP ID: ENSP00000417545
MAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPV

SEQ ID NO: 7486 - protein, 221 aa, Homo sapiens
  Payload ID: 1579;
  Gene Symbol: ATP6V1A;
  Gene Name: ATPase, H+ transporting, lysosomal 70kDa, V1 subunit A;
  ENSP ID: ENSP00000419294
MDFSKLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKL

SEQ ID NO: 7487 - protein, 49 aa, Homo sapiens
  Payload ID: 1579;
  Gene Symbol: ATP6V1A;
  Gene Name: ATPase, H+ transporting, lysosomal 70kDa, V1 subunit A;
  ENSP ID: ENSP00000420146
MDFSKLPKILDEDKESTFGYVHGVSGPAFTPCIIATLRTYLNPTSGYSL

SEQ ID NO: 7488 - protein, 65 aa, Homo sapiens
  Payload ID: 1580;
  Gene Symbol: ATP6V0E1;
  Gene Name: ATPase, H+ transporting, lysosomal 9kDa, V0 subunit e1;
  ENSP ID: ENSP00000265093
MAYHGLTVPLIVMSVFWGFVGFLVPWFIPKGPNRGWLIAILAQLNPLFGPQLKNETIWYLKYHWP

SEQ ID NO: 7489 - protein, 81 aa, Homo sapiens [sequence omitted]

SEQ ID NO: 7490 - protein, 81 aa, Homo sapiens [sequence omitted]

SEQ ID NO: 7491 - protein, 58 aa, Homo sapiens
  Payload ID: 1580;
  Gene Symbol: ATP6V0E1;
  Gene Name: ATPase, H+ transporting, lysosomal 9kDa, V0 subunit e1;
  ENSP ID: ENSP00000430896
MAYHGLTVPLIVMSVFWGFVGFLVPWFIPKGPNRGVIITMLVTCSVCCYLLSREENAF

SEQ ID NO: 7492 - protein, 470 aa, Homo sapiens
  Payload ID: 1581;
  Gene Symbol: ATP6AP1;
  Gene Name: ATPase, H+ transporting, lysosomal accessory prt 1;
  Uniprot ID:  Q15904;
  ENSP ID: ENSP00000358777
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 7493 - protein, 230 aa, Homo sapiens
  Payload ID: 1581;
  Gene Symbol: ATP6AP1;
  Gene Name: ATPase, H+ transporting, lysosomal accessory prt 1;
  ENSP ID: ENSP00000392375
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTDEVIGQVLSTLKSEDVPYTAALTAVRPSRVARD

SEQ ID NO: 7494 - protein, 133 aa, Homo sapiens
  Payload ID: 1581;
  Gene Symbol: ATP6AP1;
  Gene Name: ATPase, H+ transporting, lysosomal accessory prt 1;
  ENSP ID: ENSP00000396643
  MOD_RES (1)..(1): Any amino acid
XAAMATARVRMGPRCAQALWRMPWLPVFLSLAAAAAAAAAEQQVPLVLWSSDRDLWAPAADTHEGHITSDLQLSTYLDPALELGPRNVLLFLQDKVRPPQPTLPRSSGGSQAPSPHDTDAHSPREASVTLSQL

SEQ ID NO: 7495 - protein, 273 aa, Homo sapiens
  Payload ID: 1581;
  Gene Symbol: ATP6AP1;
  Gene Name: ATPase, H+ transporting, lysosomal accessory prt 1;
  ENSP ID: ENSP00000398511
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVARDVAVVAGGLGRQLLQKQPVSPVIHPPVSYNDTAPRILFWAQNFSVAYKDQWEDLTPLTFGVQELNLTGSFWNDSFARFILANRLYPVSARHWFTMERLEVHSNGSVAYFNAS

SEQ ID NO: 7496 - protein, 134 aa, Homo sapiens
  Payload ID: 1581;
  Gene Symbol: ATP6AP1;
  Gene Name: ATPase, H+ transporting, lysosomal accessory prt 1;
  ENSP ID: ENSP00000408317
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKVRPPQPTLPRSSGGSQAPSPHDTDAHSPREASVTLSQL

SEQ ID NO: 7497 - protein, 128 aa, Homo sapiens
  Payload ID: 1581;
  Gene Symbol: ATP6AP1;
  Gene Name: ATPase, H+ transporting, lysosomal accessory prt 1;
  ENSP ID: ENSP00000408470
AQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLEHTQVRRCPIHSGPHSGPPFQGGP

SEQ ID NO: 7498 - protein, 134 aa, Homo sapiens; identical to SEQ ID NO: 7496
  Payload ID: 1581;
  Gene Symbol: ATP6AP1;
  Gene Name: ATPase, H+ transporting, lysosomal accessory prt 1;
  ENSP ID: ENSP00000411209

SEQ ID NO: 7499 - protein, 281 aa, Homo sapiens
  Payload ID: 1581;
  Gene Symbol: ATP6AP1;
  Gene Name: ATPase, H+ transporting, lysosomal accessory prt 1;
  ENSP ID: ENSP00000482243
MAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 7500 - protein, 224 aa, Homo sapiens
  Payload ID: 1582;
  Gene Symbol: ATP6AP1L;
  Gene Name: ATPase, H+ transporting, lysosomal accessory prt 1-like;
  Uniprot ID:  Q52LC2;
  ENSP ID: ENSP00000369513
MRLWKARVLKLVLKTAKDSRLGLNSKWLSLKLGDAGNPRSLAIRFILTNYNKLSIQSWFSLRRVEIISNNSIQAVFNPTGVYAPSGYSYRCQRVGSLQQDQALLLPSDTDDGSSLWEVTFIDFQIQGFAIKGGRFTKAQDCASSFSPAFLIGLAMSLILLLVLAYALHMLIYLRYLDQQYDLIASPAHFSQLKARDTAEEKELLRSQGAECYKLRSQQISKIYV

SEQ ID NO: 7501 - protein, 224 aa, Homo sapiens; identical to SEQ ID NO: 7500
  Payload ID: 1582;
  Gene Symbol: ATP6AP1L;
  Gene Name: ATPase, H+ transporting, lysosomal accessory prt 1-like;
  Uniprot ID:  Q52LC2;
  ENSP ID: ENSP00000391381

SEQ ID NO: 7502 - protein, 350 aa, Homo sapiens
  Payload ID: 1583;
  Gene Symbol: ATP6AP2;
  Gene Name: ATPase, H+ transporting, lysosomal accessory prt 2;
  Uniprot ID:  O75787;
  ENSP ID: ENSP00000367697
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 7503 - protein, 203 aa, Homo sapiens
  Payload ID: 1583;
  Gene Symbol: ATP6AP2;
  Gene Name: ATPase, H+ transporting, lysosomal accessory prt 2;
  ENSP ID: ENSP00000403969
ESERVTSSRCGCRPCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENRVYMVGKANSVFEDLSVTLRQLRNRLFQENSVLSSLPLNSLSRNNEVDLLFLSELQVLHDISSLLSRHKHL

SEQ ID NO: 7504 - protein, 243 aa, Homo sapiens
  Payload ID: 1583;
  Gene Symbol: ATP6AP2;
  Gene Name: ATPase, H+ transporting, lysosomal accessory prt 2;
  ENSP ID: ENSP00000410105
  MOD_RES (1)..(1): Any amino acid
XCPAGPFRVAPQCCGRRGTMAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFE

SEQ ID NO: 7505 - protein, 259 aa, Homo sapiens
  Payload ID: 1583;
  Gene Symbol: ATP6AP2;
  Gene Name: ATPase, H+ transporting, lysosomal accessory prt 2;
  ENSP ID: ENSP00000411317
  MOD_RES (1)..(1): Any amino acid
XVPPARSVSPRSAAAAAAPWLCLSCSWRWWRDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAK

SEQ ID NO: 7506 - protein, 838 aa, Homo sapiens
  Payload ID: 1584;
  Gene Symbol: ATP6V0A1;
  Gene Name: ATPase, H+ transporting, lysosomal V0 subunit a1;
  Uniprot ID:  Q93050;
  ENSP ID: ENSP00000264649
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEAELHHQQMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 7507 - protein, 837 aa, Homo sapiens
  Payload ID: 1584;
  Gene Symbol: ATP6V0A1;
  Gene Name: ATPase, H+ transporting, lysosomal V0 subunit a1;
  Uniprot ID:  Q93050;
  ENSP ID: ENSP00000342951
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEPSEDEVFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 7508 - protein, 831 aa, Homo sapiens
  Payload ID: 1584;
  Gene Symbol: ATP6V0A1;
  Gene Name: ATPase, H+ transporting, lysosomal V0 subunit a1;
  Uniprot ID:  Q93050;
  ENSP ID: ENSP00000377415
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 7509 - protein, 788 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000443991
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 7510 - protein, 483 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000446377
MQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEPSEDEVFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 7511 - protein, 93 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000466290
MGELFRSEEMTLAQLFLQSEAAYCCVSELGELGKVQFRDLNPDVNVFQRKFVNEVRRCEEMDRKLRFVEKEIRKANIPIMDTGENPEVPFPRD

SEQ ID NO: 7512 - protein, 130 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000466328
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKF

SEQ ID NO: 7513 - protein, 195 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000466767
ANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTVESHSVVQARVQWRDLGSPQPPLPGFKRFSCLSLPSSWGLQGDYVHKSVFIIFFQGDQ

SEQ ID NO: 7514 - protein, 191 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000466852
PWMLLFKPLVLRRQYLRRKHLEGQPVEAPVSPNPSQQGLEAAAAATGTLNFGGIRVGNGPTEEDAEIIQHDQLSTHSEDADEPSEDEVFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNK

SEQ ID NO: 7515 - protein, 794 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000466878
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEPSEDEVFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 7516 - protein, 198 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000467373
MGELFRSEEMTLAQLFLQSEAAYCCVSELGELGKVQFRDANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEM

SEQ ID NO: 7517 - protein, 68 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000468001
MGELFRSEEMTLAQLFLQSEAAYCCVSELGELGKVQFRDLNPDVNVFQRKFVNEVRRCEEMDRKLRQF

SEQ ID NO: 7518 - protein, 129 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000468169
  MOD_RES (1)..(1): Any amino acid
XLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEALAPAQWKH

SEQ ID NO: 7519 - protein, 188 aa, Homo sapiens
  Payload ID: 1584;
  Gene Symbol: ATP6V0A1;
  Gene Name: ATPase, H+ transporting, lysosomal V0 subunit a1;
  ENSP ID: ENSP00000468177
AYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEPSEDEVFDFGDTMVHQAIHTIEYCLGCISNTASYLRLWALSLAHARLSSRINSTAGPVSSSYPSPSSIFGKGSLKSESL

SEQ ID NO: 7520 - protein, 856 aa, Homo sapiens
  Payload ID: 1585;
  Gene Symbol: ATP6V0A2;
  Gene Name: ATPase, H+ transporting, lysosomal V0 subunit a2;
  Uniprot ID:  Q9Y487;
  ENSP ID: ENSP00000332247
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSRESGATIPSFMNIIPTKETPPTRIRTNKFTEGFQNIVDAYGVGSYREVNPALFTIITFPFLFAVMFGDFGHGFVMFLFALLLVLNENHPRLNQSQEIMRMFFNGRYILLLMGLFSVYTGLIYNDCFSKSVNLFGSGWNVSAMYSSSHPPAEHKKMVLWNDSVVRHNSILQLDPSIPGVFRGPYPLGIDPIWNLATNRLTFLNSFKMKMSVILGIIHMTFGVILGIFNHLHFRKKFNIYLVSIPELLFMLCIFGYLIFMIFYKWLVFSAETSRVAPSILIEFINMFLFPASKTSGLYTGQEYVQRVLLVVTALSVPVLFLGKPLFLLWLHNGRSCFGVNRSGYTLIRKDSEEEVSLLGSQDIEEGNHQVEDGCREMACEEFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNNDDSVA

SEQ ID NO: 7521 - protein, 138 aa, Homo sapiens
  Payload ID: 1585;
  Gene Symbol: ATP6V0A2;
  Gene Name: ATPase, H+ transporting, lysosomal V0 subunit a2;
  ENSP ID: ENSP00000441143
MLCDLSQFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNNDDSVA

SEQ ID NO: 7522 - protein, 328 aa, Homo sapiens
  Payload ID: 1585;
  Gene Symbol: ATP6V0A2;
  Gene Name: ATPase, H+ transporting, lysosomal V0 subunit a2;
  ENSP ID: ENSP00000443441
MLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSRESGATIPSFMNIIPTKETPPTRIRTNKFTEGFQNIVDAYGVGSYREVNPALFTIITFPFLFAVMFGDFGHGFVMFLFALLLVLNENHPRLNQSQEIMRMFFNGRYILLLMG

SEQ ID NO: 7523 - protein, 131 aa, Homo sapiens
  Payload ID: 1585;
  Gene Symbol: ATP6V0A2;
  Gene Name: ATPase, H+ transporting, lysosomal V0 subunit a2;
  ENSP ID: ENSP00000443726
MACEEFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNN

SEQ ID NO: 7524 - protein, 372 aa, Homo sapiens
  Payload ID: 1585;
  Gene Symbol: ATP6V0A2;
  Gene Name: ATPase, H+ transporting, lysosomal V0 subunit a2;
  ENSP ID: ENSP00000482236
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSVRLPSSPLPGTEERLMELINSEKKRK

SEQ ID NO: 7525 - protein, 840 aa, Homo sapiens
  Payload ID: 1586;
  Gene Symbol: ATP6V0A4;
  Gene Name: ATPase, H+ transporting, lysosomal V0 subunit a4;
  Uniprot ID:  Q9HBG4;
  ENSP ID: ENSP00000253856
MVSVFRSEEMCLSQLFLQVEAAYCCVAELGELGLVQFKDLNMNVNSFQRKFVNEVRRCESLERILRFLEDEMQNEIVVQLLEKSPLTPLPREMITLETVLEKLEGELQEANQNQQALKQSFLELTELKYLLKKTQDFFETETNLADDFFTEDTSGLLELKAVPAYMTGKLGFIAGVINRERMASFERLLWRICRGNVYLKFSEMDAPLEDPVTKEEIQKNIFIIFYQGEQLRQKIKKICDGFRATVYPCPEPAVERREMLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAPYTIITFPFLFAVMFGDCGHGTVMLLAALWMILNERRLLSQKTDNEIWNTFFHGRYLILLMGIFSIYTGLIYNDCFSKSLNIFGSSWSVQPMFRNGTWNTHVMEESLYLQLDPAIPGVYFGNPYPFGIDPIWNLASNKLTFLNSYKMKMSVILGIVQMVFGVILSLFNHIYFRRTLNIILQFIPEMIFILCLFGYLVFMIIFKWCCFDVHVSQHAPSILIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 7526 - protein, 840 aa, Homo sapiens; identical to SEQ ID NO: 7525
  Payload ID: 1586;
  Gene Symbol: ATP6V0A4;
  Gene Name: ATPase, H+ transporting, lysosomal V0 subunit a4;
  Uniprot ID:  Q9HBG4;
  ENSP ID: ENSP00000308122

SEQ ID NO: 7527 - protein, 840 aa, Homo sapiens; identical to SEQ ID NO: 7525
  Payload ID: 1586;
  Gene Symbol: ATP6V0A4;
  Gene Name: ATPase, H+ transporting, lysosomal V0 subunit a4;
  Uniprot ID:  Q9HBG4;
  ENSP ID: ENSP00000376774

SEQ ID NO: 7528 - protein, 1035 aa, Homo sapiens
  Payload ID: 1587;
  Gene Symbol: ATP4A;
  Gene Name: ATPase, H+/K+ exchanging, alpha polypeptide;
  Uniprot ID:  P20648;
  ENSP ID: ENSP00000262623
MGKAENYELYSVELGPGPGGDMAAKMSKKKKAGGGGGKRKEKLENMKKEMEINDHQLSVAELEQKYQTSATKGLSASLAAELLLRDGPNALRPPRGTPEYVKFARQLAGGLQCLMWVAAAICLIAFAIQASEGDLTTDDNLYLAIALIAVVVVTGCFGYYQEFKSTNIIASFKNLVPQQATVIRDGDKFQINADQLVVGDLVEMKGGDRVPADIRILAAQGCKVDNSSLTGESEPQTRSPECTHESPLETRNIAFFSTMCLEGTVQGLVVNTGDRTIIGRIASLASGVENEKTPIAIEIEHFVDIIAGLAILFGATFFIVAMCIGYTFLRAMVFFMAIVVAYVPEGLLATVTVCLSLTAKRLASKNCVVKNLEAVETLGSTSVICSDKTGTLTQNRMTVSHLWFDNHIHTADTTEDQSGQTFDQSSETWRALCRVLTLCNRAAFKSGQDAVPVPKRIVIGDASETALLKFSELTLGNAMGYRDRFPKVCEIPFNSTNKFQLSIHTLEDPRDPRHLLVMKGAPERVLERCSSILIKGQELPLDEQWREAFQTAYLSLGGLGERVLGFCQLYLNEKDYPPGYAFDVEAMNFPSSGLCFAGLVSMIDPPRATVPDAVLKCRTAGIRVIMVTGDHPITAKAIAASVGIISEGSETVEDIAARLRVPVDQVNRKDARACVINGMQLKDMDPSELVEALRTHPEMVFARTSPQQKLVIVESCQRLGAIVAVTGDGVNDSPALKKADIGVAMGIAGSDAAKNAADMILLDDNFASIVTGVEQGRLIFDNLKKSIAYTLTKNIPELTPYLIYITVSVPLPLGCITILFIELCTDIFPSVSLAYEKAESDIMHLRPRNPKRDRLVNEPLAAYSYFQIGAIQSFAGFTDYFTAMAQEGWFPLLCVGLRAQWEDHHLQDLQDSYGQEWTFGQRLYQQYTCYTVFFISIEVCQIADVLIRKTRRLSAFQQGFFRNKILVIAIVFQVCIGCFLCYCPGMPNIFNFMPIRFQWWLVPLPYGILIFVYDEIRKLGVRCCPGSWWDQELYY

SEQ ID NO: 7529 - protein, 34 aa, Homo sapiens
  Payload ID: 1587;
  Gene Symbol: ATP4A;
  Gene Name: ATPase, H+/K+ exchanging, alpha polypeptide;
  ENSP ID: ENSP00000472323
  MOD_RES (1)..(1): Any amino acid
XELPLDEQWREAFQTAYLSLGGLGERVLGDHGNG

SEQ ID NO: 7530 - protein, 291 aa, Homo sapiens
  Payload ID: 1588;
  Gene Symbol: ATP4B;
  Gene Name: ATPase, H+/K+ exchanging, beta polypeptide;
  Uniprot ID:  P51164;
  ENSP ID: ENSP00000334216
MAALQEKKTCGQRMEEFQRYCWNPDTGQMLGRTLSRWVWISLYYVAFYVVMTGLFALCLYVLMQTVDPYTPDYQDQLRSPGVTLRPDVYGEKGLEIVYNVSDNRTWADLTQTLHAFLAGYSPAAQEDSINCTSEQYFFQESFRAPNHTKFSCKFTADMLQNCSGLADPNFGFEEGKPCFIIKMNRIVKFLPSNGSAPRVDCAFLDQPRELGQPLQVKYYPPNGTFSLHYFPYYGKKAQPHYSNPLVAAKLLNIPRNAEVAIVCKVMAEHVTFNNPHDPYEGKVEFKLKIEK

SEQ ID NO: 7531 - protein, 1045 aa, Homo sapiens
  Payload ID: 1589;
  Gene Symbol: ATP12A;
  Gene Name: ATPase, H+/K+ transporting, nongastric, alpha polypeptide;
  Uniprot ID:  P54707;
  ENSP ID: ENSP00000218548
MHQKTPEIYSVELSGTKDIVKTDKGDGKEKYRGLKNNCLELKKKNHKEEFQKELHLDDHKLSNRELEEKYGTDIIMGLSSTRAAELLARDGPNSLTPPKQTPEIVKFLKQMVGGFSILLWVGAFLCWIAYGIQYSSDKSASLNNVYLGCVLGLVVILTGIFAYYQEAKSTNIMSSFNKMIPQQALVIRDSEKKTIPSEQLVVGDIVEVKGGDQIPADIRVLSSQGCRVDNSSLTGESEPQPRSSEFTHENPLETKNICFYSTTCLEASTSPVGTVTGMVINTGDRTIIGHIASLASGVGNEKTPIAIEIEHFVHIVAGVAVSIGILFFIIAVSLKYQVLDSIIFLIGIIVANVPEGLLATVTVTLSLTAKRMAKKNCLVKNLEAVETLGSTSIICSDKTGTLTQNRMTVAHLWFDNQIFVADTSEDHSNQVFDQSSRTWASLSKIITLCNRAEFKPGQENVPIMKKAVIGDASETALLKFSEVILGDVMEIRKRNRKVAEIPFNSTNKFQLSIHEMDDPHGKRFLMVMKGAPERILEKCSTIMINGEEHPLDKSTAKTFHTAYMELGGLGERVLGFCHLYLPADEFPETYSFDIDAMNFPTSNLCFVGLLSMIDPPRSTVPDAVTKCRSAGIKVIMVTGDHPITAKAIAKSVGIISANSETVEDIAHRLNIAVEQVNKRDAKAAVVTGMELKDMSSEQLDEILANYQEIVFARTSPQQKLIIVEGCQRQDAVVAVTGDGVNDSPALKKADIGIAMGIAGSDAAKNAADMVLLDDNFASIVTGVEEGRLIFDNLKKTIAYSLTKNIAELCPFLIYIIVGLPLPIGTITILFIDLGTDIIPSIALAYEKAESDIMNRKPRHKNKDRLVNQPLAVYSYLHIGLMQALGAFLVYFTVYAQEGFLPRTLINLRVEWEKDYVNDLKDSYGQEWTRYQREYLEWTGYTAFFVGILVQQIADLIIRKTRRNSIFQQGLFRNKVIWVGITSQIIIGLILSYGLGSVTALSFTMLRAQYWFVAVPHAILIWVYDEVRKLFIRLYPGSWWDKNMYY

SEQ ID NO: 7532 - protein, 1039 aa, Homo sapiens
  Payload ID: 1589;
  Gene Symbol: ATP12A;
  Gene Name: ATPase, H+/K+ transporting, nongastric, alpha polypeptide;
  Uniprot ID:  P54707;
  ENSP ID: ENSP00000371372
MHQKTPEIYSVELSGTKDIVKTDKGDGKEKYRGLKNNCLELKKKNHKEEFQKELHLDDHKLSNRELEEKYGTDIIMGLSSTRAAELLARDGPNSLTPPKQTPEIVKFLKQMVGGFSILLWVGAFLCWIAYGIQYSSDKSASLNNVYLGCVLGLVVILTGIFAYYQEAKSTNIMSSFNKMIPQQALVIRDSEKKTIPSEQLVVGDIVEVKGGDQIPADIRVLSSQGCRVDNSSLTGESEPQPRSSEFTHENPLETKNICFYSTTCLEGTVTGMVINTGDRTIIGHIASLASGVGNEKTPIAIEIEHFVHIVAGVAVSIGILFFIIAVSLKYQVLDSIIFLIGIIVANVPEGLLATVTVTLSLTAKRMAKKNCLVKNLEAVETLGSTSIICSDKTGTLTQNRMTVAHLWFDNQIFVADTSEDHSNQVFDQSSRTWASLSKIITLCNRAEFKPGQENVPIMKKAVIGDASETALLKFSEVILGDVMEIRKRNRKVAEIPFNSTNKFQLSIHEMDDPHGKRFLMVMKGAPERILEKCSTIMINGEEHPLDKSTAKTFHTAYMELGGLGERVLGFCHLYLPADEFPETYSFDIDAMNFPTSNLCFVGLLSMIDPPRSTVPDAVTKCRSAGIKVIMVTGDHPITAKAIAKSVGIISANSETVEDIAHRLNIAVEQVNKRDAKAAVVTGMELKDMSSEQLDEILANYQEIVFARTSPQQKLIIVEGCQRQDAVVAVTGDGVNDSPALKKADIGIAMGIAGSDAAKNAADMVLLDDNFASIVTGVEEGRLIFDNLKKTIAYSLTKNIAELCPFLIYIIVGLPLPIGTITILFIDLGTDIIPSIALAYEKAESDIMNRKPRHKNKDRLVNQPLAVYSYLHIGLMQALGAFLVYFTVYAQEGFLPRTLINLRVEWEKDYVNDLKDSYGQEWTRYQREYLEWTGYTAFFVGILVQQIADLIIRKTRRNSIFQQGLFRNKVIWVGITSQIIIGLILSYGLGSVTALSFTMLRAQYWFVAVPHAILIWVYDEVRKLFIRLYPGSWWDKNMYY

SEQ ID NO: 7533 - protein, 1023 aa, Homo sapiens
  Payload ID: 1590;
  Gene Symbol: ATP1A1;
  Gene Name: ATPase, Na+/K+ transporting, alpha 1 polypeptide;
  Uniprot ID:  P05023;
  ENSP ID: ENSP00000295598
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 7534 - protein, 144 aa, Homo sapiens
  Payload ID: 1590;
  Gene Symbol: ATP1A1;
  Gene Name: ATPase, Na+/K+ transporting, alpha 1 polypeptide;
  ENSP ID: ENSP00000358506
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNG

SEQ ID NO: 7535 - protein, 992 aa, Homo sapiens
  Payload ID: 1590;
  Gene Symbol: ATP1A1;
  Gene Name: ATPase, Na+/K+ transporting, alpha 1 polypeptide;
  Uniprot ID:  P05023;
  ENSP ID: ENSP00000358508
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 7536 - protein, 157 aa, Homo sapiens
  Payload ID: 1590;
  Gene Symbol: ATP1A1;
  Gene Name: ATPase, Na+/K+ transporting, alpha 1 polypeptide;
  ENSP ID: ENSP00000396236
RQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKTLTQYS

SEQ ID NO: 7537 - protein, 106 aa, Homo sapiens
  Payload ID: 1590;
  Gene Symbol: ATP1A1;
  Gene Name: ATPase, Na+/K+ transporting, alpha 1 polypeptide;
  ENSP ID: ENSP00000400124
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLS

SEQ ID NO: 7538 - protein, 1023 aa, Homo sapiens
  Payload ID: 1590;
  Gene Symbol: ATP1A1;
  Gene Name: ATPase, Na+/K+ transporting, alpha 1 polypeptide;
  Uniprot ID:  P05023;
  ENSP ID: ENSP00000445306
MAFKVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 7539 - protein, 1020 aa, Homo sapiens
  Payload ID: 1591;
  Gene Symbol: ATP1A2;
  Gene Name: ATPase, Na+/K+ transporting, alpha 2 polypeptide;
  Uniprot ID:  P50993;
  ENSP ID: ENSP00000354490
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 7540 - protein, 1009 aa, Homo sapiens
  Payload ID: 1591;
  Gene Symbol: ATP1A2;
  Gene Name: ATPase, Na+/K+ transporting, alpha 2 polypeptide;
  ENSP ID: ENSP00000376066
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLNLLIFIYDEVRKLILRRYPGGWVEKETYY

SEQ ID NO: 7541 - protein, 714 aa, Homo sapiens
  Payload ID: 1591;
  Gene Symbol: ATP1A2;
  Gene Name: ATPase, Na+/K+ transporting, alpha 2 polypeptide;
  ENSP ID: ENSP00000411705
  MOD_RES (1)..(1): Any amino acid
XQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 7542 - protein, 1013 aa, Homo sapiens
  Payload ID: 1592;
  Gene Symbol: ATP1A3;
  Gene Name: ATPase, Na+/K+ transporting, alpha 3 polypeptide;
  Uniprot ID:  P13637;
  ENSP ID: ENSP00000302397
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 7543 - protein, 1226 aa, Homo sapiens
  Payload ID: 1592;
  Gene Symbol: ATP1A3;
  Gene Name: ATPase, Na+/K+ transporting, alpha 3 polypeptide;
  ENSP ID: ENSP00000411503
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGEGARQGSRGGRGAAGSQAAGPRLPSPCWMALPPGSHSSLSSHLSGHPLCLLTGLCLCGFLVSLPLCPSLCWAARLACLSPSLTLSLSFLLCLSRLGGEGNLLLTSAPPHRPSLPRPPGPGPPLSVPPILYSGGRSPLFLWPHLGPHPLHYLLPPPLWLASLPCPKPLSSLFSVSVSLPLLTPLSIPPAPATSLGSFLLPFSPPADAISGSGQLSNISVGRE

SEQ ID NO: 7544 - protein, 1024 aa, Homo sapiens
  Payload ID: 1592;
  Gene Symbol: ATP1A3;
  Gene Name: ATPase, Na+/K+ transporting, alpha 3 polypeptide;
  Uniprot ID:  P13637;
  ENSP ID: ENSP00000437577
MGGWEEERNRRATDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 7545 - protein, 1026 aa, Homo sapiens
  Payload ID: 1592;
  Gene Symbol: ATP1A3;
  Gene Name: ATPase, Na+/K+ transporting, alpha 3 polypeptide;
  Uniprot ID:  P13637;
  ENSP ID: ENSP00000444688
MGSGGSDSYRIATSQDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 7546 - protein, 251 aa, Homo sapiens
  Payload ID: 1592;
  Gene Symbol: ATP1A3;
  Gene Name: ATPase, Na+/K+ transporting, alpha 3 polypeptide;
  ENSP ID: ENSP00000469129
MTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHF

SEQ ID NO: 7547 - protein, 983 aa, Homo sapiens
  Payload ID: 1592;
  Gene Symbol: ATP1A3;
  Gene Name: ATPase, Na+/K+ transporting, alpha 3 polypeptide;
  ENSP ID: ENSP00000471581
MTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 7548 - protein, 1029 aa, Homo sapiens
  Payload ID: 1593;
  Gene Symbol: ATP1A4;
  Gene Name: ATPase, Na+/K+ transporting, alpha 4 polypeptide;
  Uniprot ID:  Q13733;
  ENSP ID: ENSP00000357060
MGLWGKKGTVAPHDQSPRRRPKKGLIKKKMVKREKQKRNMEELKKEVVMDDHKLTLEELSTKYSVDLTKGHSHQRAKEILTRGGPNTVTPPPTTPEWVKFCKQLFGGFSLLLWTGAILCFVAYSIQIYFNEEPTKDNLYLSIVLSVVVIVTGCFSYYQEAKSSKIMESFKNMVPQQALVIRGGEKMQINVQEVVLGDLVEIKGGDRVPADLRLISAQGCKVDNSSLTGESEPQSRSPDFTHENPLETRNICFFSTNCVEGTARGIVIATGDSTVMGRIASLTSGLAVGQTPIAAEIEHFIHLITVVAVFLGVTFFALSLLLGYGWLEAIIFLIGIIVANVPEGLLATVTVCLTLTAKRMARKNCLVKNLEAVETLGSTSTICSDKTGTLTQNRMTVAHMWFDMTVYEADTTEEQTGKTFTKSSDTWFMLARIAGLCNRADFKANQEILPIAKRATTGDASESALLKFIEQSYSSVAEMREKNPKVAEIPFNSTNKYQMSIHLREDSSQTHVLMMKGAPERILEFCSTFLLNGQEYSMNDEMKEAFQNAYLELGGLGERVLGFCFLNLPSSFSKGFPFNTDEINFPMDNLCFVGLISMIDPPRAAVPDAVSKCRSAGIKVIMVTGDHPITAKAIAKGVGIISEGTETAEEVAARLKIPISKVDASAAKAIVVHGAELKDIQSKQLDQILQNHPEIVFARTSPQQKLIIVEGCQRLGAVVAVTGDGVNDSPALKKADIGIAMGISGSDVSKQAADMILLDDNFASIVTGVEEGRLIFDNLKKSIMYTLTSNIPEITPFLMFIILGIPLPLGTITILCIDLGTDMVPAISLAYESAESDIMKRLPRNPKTDNLVNHRLIGMAYGQIGMIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 7549 - protein, 165 aa, Homo sapiens
  Payload ID: 1593;
  Gene Symbol: ATP1A4;
  Gene Name: ATPase, Na+/K+ transporting, alpha 4 polypeptide;
  Uniprot ID:  Q13733;
  ENSP ID: ENSP00000433094
MIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 7550 - protein, 517 aa, Homo sapiens
  Payload ID: 1593;
  Gene Symbol: ATP1A4;
  Gene Name: ATPase, Na+/K+ transporting, alpha 4 polypeptide;
  ENSP ID: ENSP00000434272
MGLWGKKGTVAPHDQSPRRRPKKGLIKKKMVKREKQKRNMEELKKEVVMDDHKLTLEELSTKYSVDLTKGHSHQRAKEILTRGGPNTVTPPPTTPEWVKFCKQLFGGFSLLLWTGAILCFVAYSIQIYFNEEPTKDNLYLSIVLSVVVIVTGCFSYYQEAKSSKIMESFKNMVPQQALVIRGGEKMQINVQEVVLGDLVEIKGGDRVPADLRLISAQGCKVDNSSLTGESEPQSRSPDFTHENPLETRNICFFSTNCVEGTARGIVIATGDSTVMGRIASLTSGLAVGQTPIAAEIEHFIHLITVVAVFLGVTFFALSLLLGYGWLEAIIFLIGIIVANVPEGLLATVTVCLTLTAKRMARKNCLVKNLEAVETLGSTSTICSDKTGTLTQNRMTVAHMWFDMTVYEADTTEEQTGKTFTKSSDTWFMLARIAGLCNRADFKANQEILPIAKRATTGDASESALLKFIEQSYSSVAEMREKNPKVAEIPFNSTNKYQVQNPQRCPSTFGRTAPRPTY

SEQ ID NO: 7551 - protein, 303 aa, Homo sapiens
  Payload ID: 1594;
  Gene Symbol: ATP1B1;
  Gene Name: ATPase, Na+/K+ transporting, beta 1 polypeptide;
  Uniprot ID:  P05026;
  ENSP ID: ENSP00000356789
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 7552 - protein, 303 aa, Homo sapiens; identical to SEQ ID NO: 7551
  Payload ID: 1594;
  Gene Symbol: ATP1B1;
  Gene Name: ATPase, Na+/K+ transporting, beta 1 polypeptide;
  Uniprot ID:  P05026;
  ENSP ID: ENSP00000356790

SEQ ID NO: 7553 - protein, 130 aa, Homo sapiens
  Payload ID: 1594;
  Gene Symbol: ATP1B1;
  Gene Name: ATPase, Na+/K+ transporting, beta 1 polypeptide;
  ENSP ID: ENSP00000477015
MLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGF

SEQ ID NO: 7554 - protein, 290 aa, Homo sapiens
  Payload ID: 1595;
  Gene Symbol: ATP1B2;
  Gene Name: ATPase, Na+/K+ transporting, beta 2 polypeptide;
  Uniprot ID:  P14415;
  ENSP ID: ENSP00000250111
MVIQKEKKSCGQVVEEWKEFVWNPRTHQFMGRTGTSWAFILLFYLVFYGFLTAMFTLTMWVMLQTVSDHTPKYQDRLATPGLMIRPKTENLDVIVNVSDTESWDQHVQKLNKFLEPYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 7555 - protein, 166 aa, Homo sapiens
  Payload ID: 1595;
  Gene Symbol: ATP1B2;
  Gene Name: ATPase, Na+/K+ transporting, beta 2 polypeptide;
  ENSP ID: ENSP00000459145
MIRPKTENLDVIVNVSDTESWDQHVQKLNKFLEPYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKF

SEQ ID NO: 7556 - protein, 172 aa, Homo sapiens
  Payload ID: 1595;
  Gene Symbol: ATP1B2;
  Gene Name: ATPase, Na+/K+ transporting, beta 2 polypeptide;
  ENSP ID: ENSP00000460499
  MOD_RES (1)..(1): Any amino acid
XEQPDNGVLNYPKRACQFNRTQLGNCSGIGDSTHYGYSTGQPCVFIKMNRVINFYAGANQSMNVTCAGKRPHHHRNKGKLIPEDGRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 7557 - protein, 279 aa, Homo sapiens
  Payload ID: 1596;
  Gene Symbol: ATP1B3;
  Gene Name: ATPase, Na+/K+ transporting, beta 3 polypeptide;
  Uniprot ID:  P54709;
  ENSP ID: ENSP00000286371
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 7558 - protein, 133 aa, Homo sapiens
  Payload ID: 1596;
  Gene Symbol: ATP1B3;
  Gene Name: ATPase, Na+/K+ transporting, beta 3 polypeptide;
  ENSP ID: ENSP00000417522
MWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRID

SEQ ID NO: 7559 - protein, 27 aa, Homo sapiens
  Payload ID: 1596;
  Gene Symbol: ATP1B3;
  Gene Name: ATPase, Na+/K+ transporting, beta 3 polypeptide;
  ENSP ID: ENSP00000417608
IIGLKPEGVPRIDCVSKLVGVLVISAI

SEQ ID NO: 7560 - protein, 44 aa, Homo sapiens
  Payload ID: 1596;
  Gene Symbol: ATP1B3;
  Gene Name: ATPase, Na+/K+ transporting, beta 3 polypeptide;
  ENSP ID: ENSP00000418280
MTKNEKKSLNQSLAEWKLFIYNPTTGEFLGRTAKSWGSQYVVGK

SEQ ID NO: 7561 - protein, 89 aa, Homo sapiens
  Payload ID: 1596;
  Gene Symbol: ATP1B3;
  Gene Name: ATPase, Na+/K+ transporting, beta 3 polypeptide;
  ENSP ID: ENSP00000418353
MGSWLHSSHSRCGLCFRLSTMRFQNTVTRFLAQVGYLQPLVAVQVSFAPNNTGKEVTVECKIDGSANLKSQDDRDKFLGRVMFKITARA

SEQ ID NO: 7562 - protein, 43 aa, Homo sapiens
  Payload ID: 1596;
  Gene Symbol: ATP1B3;
  Gene Name: ATPase, Na+/K+ transporting, beta 3 polypeptide;
  ENSP ID: ENSP00000418952
  MOD_RES (1)..(1): Any amino acid
XKNEKKSLNQSLAEWKLFIYNPTTGEFLGRTAKSWGSQYVVGK

SEQ ID NO: 7563 - protein, 119 aa, Homo sapiens
  Payload ID: 1596;
  Gene Symbol: ATP1B3;
  Gene Name: ATPase, Na+/K+ transporting, beta 3 polypeptide;
  ENSP ID: ENSP00000419962
MLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGAL

SEQ ID NO: 7564 - protein, 357 aa, Homo sapiens
  Payload ID: 1597;
  Gene Symbol: ATP1B4;
  Gene Name: ATPase, Na+/K+ transporting, beta 4 polypeptide;
  Uniprot ID:  Q9UN42;
  ENSP ID: ENSP00000218008
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGQSWSLILLIYFFFYASLAAVITLCMYTLFLTISPYIPTFTERVKPPGVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 7565 - protein, 353 aa, Homo sapiens
  Payload ID: 1597;
  Gene Symbol: ATP1B4;
  Gene Name: ATPase, Na+/K+ transporting, beta 4 polypeptide;
  Uniprot ID:  Q9UN42;
  ENSP ID: ENSP00000355346
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGLILLIYFFFYASLAAVITLCMYTLFLTISPYIPTFTERVKPPGVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 7566 - protein, 314 aa, Homo sapiens
  Payload ID: 1597;
  Gene Symbol: ATP1B4;
  Gene Name: ATPase, Na+/K+ transporting, beta 4 polypeptide;
  ENSP ID: ENSP00000443334
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGQSWRVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 7567 - protein, 123 aa, Homo sapiens
  Payload ID: 1598;
  Gene Symbol: ABCA1;
  Gene Name: ATP-binding cassette, sub-family A (ABC1), member 1;
  ENSP ID: ENSP00000363865
MPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVS

SEQ ID NO: 7568 - protein, 2261 aa, Homo sapiens
  Payload ID: 1598;
  Gene Symbol: ABCA1;
  Gene Name: ATP-binding cassette, sub-family A (ABC1), member 1;
  Uniprot ID:  O95477;
  ENSP ID: ENSP00000363868
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 7569 - protein, 363 aa, Homo sapiens
  Payload ID: 1598;
  Gene Symbol: ABCA1;
  Gene Name: ATP-binding cassette, sub-family A (ABC1), member 1;
  ENSP ID: ENSP00000416623
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILMDVTCDDIAHGQLTVPRSAAVAATGDAKPNMMGRETLLSICASVPKVEFHERHILKHFSFCVCVSVSLFPAKGIVSFSWASFRIWVLWKAVFWQHGESMAVWEGQLGLGLNIAFEYFTSIDVG

SEQ ID NO: 7570 - protein, 1543 aa, Homo sapiens
  Payload ID: 1599;
  Gene Symbol: ABCA10;
  Gene Name: ATP-binding cassette, sub-family A (ABC1), member 10;
  Uniprot ID:  Q8WWZ4;
  ENSP ID: ENSP00000269081
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWGLTYICFIFIMSIFMALVITSIPIVFHTGFMVIFTLYSLYGLSLIALAFLMSVLIRKPMLAGLAGFLFTVFWGCLGFTVLYRQLPLSLGWVLSLLSPFAFTAGMAQITHLDNYLSGVIFPDPSGDSYKMIATFFILAFDTLFYLIFTLYFERVLPDKDGHGDSPLFFLKSSFWSKHQNTHHEIFENEINPEHSSDDSFEPVSPEFHGKEAIRIRNVIKEYNGKTGKVEALQGIFFDIYEGQITAILGHNGAGKSTLLNILSGLSVSTEGSATIYNTQLSEITDMEEIRKNIGFCPQFNFQFDFLTVRENLRVFAKIKGIQPKEVEQEVKRIIMELDMQSIQDIIAKKLSGGQKRKLTLGIAILGDPQVLLLDEPTAGLDPFSRHRVWSLLKEHKVDRLILFSTQFMDEADILADRKVFLSNGKLKCAGSSLFLKRKWGIGYHLSLHRNEMCDTEKITSLIKQHIPDAKLTTESEEKLVYSLPLEKTNKFPDLYSDLDKCSDQGIRNYAVSVTSLNEVFLNLEGKSAIDEPDFDIGKQEKIHVTRNTGDESEMEQVLCSLPETRKAVSSAALWRRQIYAVATLRFLKLRRERRALLCLLLVLGIAFIPIILEKIMYKVTRETHCWEFSPSMYFLSLEQIPKTPLTSLLIVNNTGSNIEDLVHSLKCQDIVLEIDDFRNRNGSDDPSYNGAIIVSGDQKDYRFSVACNTKKLNCFPVLMGIVSNALMGIFNFTELIQMESTSFSRDDIVLDLGFIDGSIFLLLITNCVSPFIGMSSISDYKKNVQSQLWISGLWPSAYWCGQALVDIPLYFLILFSIHLIYYFIFLGFQLSWELMFVLVVCIIGCAVSLIFLTYVLSFIFRKWRKNNGFWSFGFFIILICVSTIMVSTQYEKLNLILCMIFIPSFTLLGYVMLLIQLDFMRNLDSLDNRINEVNKTILLTTLIPYLQSVIFLFVIRCLEMKYGNEIMNKDPVFRISPRSRETHPNPEEPEEEDEDVQAERVQAANALTAPNLEEEPVITASCLHKEYYETKKSCFSTRKKKIAIRNVSFCVKKGEVLGLLGHNGAGKSTSIKMITGCTKPTAGVVVLQGSRASVRQQHDNSLKFLGYCPQENSLWPKLTMKEHLELYAAVKGLGKEDAALSISRLVEALKLQEQLKAPVKTLSEGIKRKLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQVFLELCKEQELGNVDDKIDTTVEWKLLPQEDP

SEQ ID NO: 7571 - protein, 1326 aa, Homo sapiens
  Payload ID: 1599;
  Gene Symbol: ABCA10;
  Gene Name: ATP-binding cassette, sub-family A (ABC1), member 10;
  ENSP ID: ENSP00000428032
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWGLTYICFIFIMSIFMALVITSIPIVFHTGFMVIFTLYSLYGLSLIALAFLMSVLIRKPMLAGLAGFLFTVFWGCLGFTVLYRQLPLSLGWVLSLLSPFAFTAGMAQITHLDNYLSGVIFPDPSGDSYKMIATFFILAFDTLFYLIFTLYFERVLPDKDGHGDSPLFFLKSSFWSKHQNTHHEIFENEINPEHSSDDSFEPVSPEFHGKEAIRIRNVIKEYNGKTGKVEALQGIFFDIYEGQITAILGHNGAGKSTLLNILSGLSVSTEGSATIYNTQLSEITDMEEIRKNIGFCPQFNFQFDFLTVRENLRVFAKIKGIQPKEVEQEVKRIIMELDMQSIQDIIAKKLSGGQKRKLTLGIAILGDPQVLLLDEPTAGLDPFSRHRVWSLLKEHKVDRLILFSTQFMDEADILADRKVFLSNGKLKCAGSSLFLKRKWGIGYHLSLHRNEMCDTEKITSLIKQHIPDAKLTTESEEKLVYSLPLEKTNKFPDLYSDLDKCSDQGIRNYAVSVTSLNEVFLNLEGKSAIDEPDFDIGKQEKIHVTRNTGDESEMEQVLCSLPETRKAVSSAALWRRQIYAVATLRFLKLRRERRALLCLLLVLGIAFIPIILEKIMYKVTRETHCWEFSPSMYFLSLEQIPKTPLTSLLIVNNTGSNIEDLVHSLKCQDIVLEIDDFRNRNGSDDPSYNGAIIVSGDQKDYRFSVACNTKKLNCFPVLMGIVSNALMGIFNFTELIQMESTSFSRDDIVLDLGFIDGSIFLLLITNCVSPFIGMSSISDYKKNVQSQLWISGLWPSAYWCGQALVDIPLYFLILFSIHLIYYFIFLGFQLSWELMFVLVVCIIGCAVSLIFLTYVLSFIFRKWRKNNGFWSFGFFIILICVSTIMVSTQYEKLNLILCMIFIPSFTLLGYVMLLIQLDFMRNLDSLDNRINEVNKTILLTTLIPYLQSVIFLFVIRCLEMKYGNEIMNKDPVFRISPRSRETHPNPEEPEEEDEDVQAERVQAANALTAPNLEEEPVITASCLHKEYYETKKSCFSTRKKKIAIRNVSFCVKKGEVLGLLGHNGAGKSTSIKMITGCTKPTAGVVVLQGSRASVRQQHDNSLKFLGYCPQENSLWPKLTMKEHLELYAAVKGLGKEDAALSISRCALC

SEQ ID NO: 7572 - protein, 137 aa, Homo sapiens
  Payload ID: 1599;
  Gene Symbol: ABCA10;
  Gene Name: ATP-binding cassette, sub-family A (ABC1), member 10;
  ENSP ID: ENSP00000429795
  MOD_RES (1)..(1): Any amino acid
XSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAF

SEQ ID NO: 7573 - protein, 452 aa, Homo sapiens
  Payload ID: 1599;
  Gene Symbol: ABCA10;
  Gene Name: ATP-binding cassette, sub-family A (ABC1), member 10;
  Uniprot ID:  Q8WWZ4;
  ENSP ID: ENSP00000429853
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWGLTYICFIFIMSIFMALVITSIPIVFHTGFMVIFTLYSLYGLSLIALAFLMSVLIRKPMLAGLAGFLFTVFWGCLGFTVLYRQLPLSLGWVLSLLSPFAFTAGMAQITHLDNYLSGVIFPDPSGDSYKMIATFFILAFDTLFYLIFTLYFERVLPDKDGHGDSPLFFLKSSFWSKHQNTHHEIFENEINPEHSSDDSFEPVSPEFHGKEAIRIRNVIKEYNGKTGKVEALQGSEERLCPAAHRLRCGERLCPAAHHLGCEERPCPAATPSGN

SEQ ID NO: 7574 - protein, 92 aa, Homo sapiens
  Payload ID: 1599;
  Gene Symbol: ABCA10;
  Gene Name: ATP-binding cassette, sub-family A (ABC1), member 10;
  Uniprot ID:  Q8WWZ4;
  ENSP ID: ENSP00000429945
MNKMALASFMKGRTVIGTPDEETMDIELPKKYHEMVGVIFSDTFSYRLKFNWGYRIPVIKEHSEYTGHNKSFCNGGVDISYWNKYEDTTFHF

SEQ ID NO: 7575 - protein, 340 aa, Homo sapiens
  Payload ID: 1599;
  Gene Symbol: ABCA10;
  Gene Name: ATP-binding cassette, sub-family A (ABC1), member 10;
  ENSP ID: ENSP00000430341
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWGLTYICFIFIMSIFMALVITSIPIVFHTGFMVIFTLYSLYGLSLIALAFLMSVLIRKPMLAGLAGFLFTVFWGCLGFTVLYRQLPLSLGWVLSLLSPFAFTAGMAQITHLDNYLSGVIFPDPSGDSYKMIATFFILAFDTLFYLIFTLYFERVLPESEML

SEQ ID NO: 7576 - protein, 76 aa, Homo sapiens
  Payload ID: 1599;
  Gene Symbol: ABCA10;
  Gene Name: ATP-binding cassette, sub-family A (ABC1), member 10;
  ENSP ID: ENSP00000466506
  MOD_RES (1)..(1): Any amino acid
XYSSLMAYKLPVEDVHPLSRAFFKLEAMKQTFNLEEYSLSQATLEQKQCEASLDADIGTTLLVQPVVSESQLKKSA

SEQ ID NO: 7577 - protein, 45 aa, Homo sapiens
  Payload ID: 1599;
  Gene Symbol: ABCA10;
  Gene Name: ATP-binding cassette, sub-family A (ABC1), member 10;
  ENSP ID: ENSP00000468351
YSSLMAYKLPVEDVHPLSRAFFKLEAMKQTFNLEEYSLSQATLEQ

SEQ ID NO: 7578 - protein, 2595 aa, Homo sapiens
  Payload ID: 1600;
  Gene Symbol: ABCA12;
  Gene Name: ATP-binding cassette, sub-family A (ABC1), member 12;
  Uniprot ID:  Q86UK0;
  ENSP ID: ENSP00000272895
MASLFHQLQILVWKNWLGVKRQPLWTLVLILWPVIIFIILAITRTKFPPTAKPTCYLAPRNLPSTGFFPFLQTLLCDTDSKCKDTPYGPQDLLRRKGIDDALFKDSEILRKSSNLDKDSSLSFQSTQVPERRHASLATVFPSPSSDLEIPGTYTFNGSQVLARILGLEKLLKQNSTSEDIRRELCDSYSGYIVDDAFSWTFLGRNVFNKFCLSNMTLLESSLQELNKQFSQLSSDPNNQKIVFQEIVRMLSFFSQVQEQKAVWQLLSSFPNVFQNDTSLSNLFDVLRKANSVLLVVQKVYPRFATNEGFRTLQKSVKHLLYTLDSPAQGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 7579 - protein, 2277 aa, Homo sapiens
  Payload ID: 1600;
  Gene Symbol: ABCA12;
  Gene Name: ATP-binding cassette, sub-family A (ABC1), member 12;
  Uniprot ID:  Q86UK0;
  ENSP ID: ENSP00000374312
MFTYIKIITSGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 7580 - protein, 90 aa, Homo sapiens
  Payload ID: 1600;
  Gene Symbol: ABCA12;
  Gene Name: ATP-binding cassette, sub-family A (ABC1), member 12;
  ENSP ID: ENSP00000400231
MASLFHQLQILVWKNWLGVKRQPLWTLVLILWPVIIFIILAITRTKFPPTAKPTWDSSTWNTCDGWMAQIFFFSCINEETDSRYRVMIAQ

SEQ ID NO: 7581 - protein, 155 aa, Homo sapiens
  Payload ID: 1601;
  Gene Symbol: ABCA13;
  Gene Name: ATP-binding cassette, sub-family A (ABC1), member 13;
  ENSP ID: ENSP00000389861
  MOD_RES (1)..(1): Any amino acid
XLESIRQCGVALCIVLGFSILSASIGSSVLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKY

SEQ ID NO: 7582 - protein, 831 aa, Homo sapiens
  Payload ID: 1601;
  Gene Symbol: ABCA13;
  Gene Name: ATP-binding cassette, sub-family A (ABC1), member 13;
  ENSP ID: ENSP00000391042
VQGVQLLRAQVAAILARRLRRTLRAGKSTLADLLLPVLFVALAMGLFMVRPLATEYPPLRLTPGHYQRAETYFFRKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNEDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 7583 - protein, 1192 aa, Homo sapiens
  Payload ID: 1601;
  Gene Symbol: ABCA13;
  Gene Name: ATP-binding cassette, sub-family A (ABC1), member 13;
  ENSP ID: ENSP00000396789
  MOD_RES (1)..(1): Any amino acid
XIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNEDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHRFWYQDDAGLIK

SEQ ID NO: 7584 - protein, 317 aa, Homo sapiens
  Payload ID: 1601;
  Gene Symbol: ABCA13;
  Gene Name: ATP-binding cassette, sub-family A (ABC1), member 13;
  Uniprot ID:  Q86UQ4;
  ENSP ID: ENSP00000409268
MGHAGCQFKALLWKNWLCRLRNPVLFLAEFFWPCILFVILTVLRFQEPPRYRDICYLQPRDLPSCGVIPFVQSLLCNTGSRCRNFSYEGSMEHHFRLSRFQTAADPKKVNNLAFLKEIQDLAEEIHGMMDKAKNLKRLWVERSNTPDSSYGSSFFTMDLNKTEEVILKLESLHQQPHIWDFLLLLPRLHTSHDHVEDGMDVAVNLLQTILNSLISLEDLDWLPLNQTFSQVSELVLNVTISTLTFLQQHGVAVTEPVYHLSMQNIVWDPQKVQYDLKSQFGFDDLHTEQILNSSAELKEVHMLDCFSHRWAFPGDWI

SEQ ID NO: 7585 - protein, 5058 aa, Homo sapiens
  Payload ID: 1601;
  Gene Symbol: ABCA13;
  Gene Name: ATP-binding cassette, sub-family A (ABC1), member 13;
  ENSP ID: ENSP00000411096
MGHAGCQFKALLWKNWLCRLRNPVLFLAEFFWPCILFVILTVLRFQEPPRYRDICYLQPRDLPSCGVIPFVQSLLCNTGSRCRNFSYEGSMEHHFRLSRFQTAADPKKVNNLAFLKEIQDLAEEIHGMMDKAKNLKRLWVERSNTPDSSYGSSFFTMDLNKTEEVILKLESLHQQPHIWDFLLLLPRLHTSHDHVEDGMDVAVNLLQTILNSLISLEDLDWLPLNQTFSQVSELVLNVTISTLTFLQQHGVAVTEPVYHLSMQNIVWDPQKVQYDLKSQFGFDDLHTEQILNSSAELKEIPTDTSLEKMVCSVLSSTSEDEAEKWGHVGGCHPKWSEAKNYLVHAVSWLRVYQQVFVQWQQGSLLQKTLTGMGHSLEALRNQFEEESKPWKVVEALHTALLLLNDSLSADGPKDNHTFPKILQHLWKLQSLLQNLPQWPALKRFLQLDGALRNAIAQNLHFVQEVLICLETSANDFKWFELNQLKLEKDVFFWELKQMLAKNAVCPNGRFSEKEVFLPPGNSSIWGGLQGLLCYCNSSETSVLNKLLGSVEDADRILQEVITWHKNMSVLIPEEYLDWQELEMQLSEASLSCTRLFLLLGADPSPENDVFSSDCKHQLVSTVIFHTLEKTQFFLEQAYYWKAFKKFIRKTCEVAQYVNMQESFQNRLLAFPEESPCFEENMDWKMISDNYFQFLNNLLKSPTASISRALNFTKHLLMMEKKLHTLEDEQMNFLLSFVEFFEKLLLPNLFDSSIVPSFHSLPSLTEDILNISSLWTNHLKSLKRDPSATDAQKLLEFGNEVIWKMQTLGSHWIRKEPKNLLRFIELILFEINPKLLELWAYGISKGKRAKLENFFTLLNFSVPENEILSTSFNFSQLFHSDWPKSPAMNIDFVRLSEAIITSLHEFGFLEQEQISEALNTVYAIRNASDLFSALSEPQKQEVDKILTHIHLNVFQDKDSALLLQIYSSFYRYIYELLNIQSRGSSLTFLTQISKHILDIIKQFNFQNISKAFAFLFKTAEVLGGISNVSYCQQLLSIFNFLELQAQSFMSTEGQELEVIHTTLTGLKQLLIIDEDFRISLFQYMSQFFNSSVEDLLDNKCLISDNKHISSVNYSTSEESSFVFPLAQIFSNLSANVSVFNKFMSIHCTVSWLQMWTEIWETISQLFKFDMNVFTSLHHGFTQLLDELEDDVKVSKSCQGILPTHNVARLILNLFKNVTQANDFHNWEDFLDLRDFLVALGNALVSVKKLNLEQVEKSLFTMEAALHQLKTFPFNESTSREFLNSLLEVFIEFSSTSEYIVRNLDSINDFLSNNLTNYGEKFENIITELREAIVFLRNVSHDRDLFSCADIFQNVTECILEDGFLYVNTSQRMLRILDTLNSTFSSENTISSLKGCIVWLDVINHLYLLSNSSFSQGHLQNILGNFRDIENKMNSILKIVTWVLNIKKPLCSSNGSHINCVNIYLKDVTDFLNIVLTTVFEKEKKPKFEILLALLNDSTKQVRMSINNLTTDFDFASQSNWRYFTELILRPIEMSDEIPNQFQNIWLHLITLGKEFQKLVKGIYFNILENNSSSKTENLLNIFATSPKEKDVNSVGNSIYHLASYLAFSLSHDLQNSPKIIISPEIMKATGLGIQLIRDVFNSLMPVVHHTSPQNAGYMQALKKVTSVMRTLKKADIDLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKTVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISRAGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMSFVPKDKILEILKLDQFLTLMIQDRLMNIFSSLKETIYHLMKSSFILDNGEFYFDTHQGLKFMQDLFNALLRETSMKNKTENNIDFFTVVSQLFFHVNKSEDLFKLNQDLGSALHLVRECSTEMARLLDTILHSPNKDFYALYPTLQEVILANLTDLLFFINNSFPLRNRATLEITKRLVGAISRASEESHVLKPLLEMSGTLVMLLNDSADLRDLATSMDSIVKLLKLVKKVSGKMSTVFKTHFISNTKDSVKFFDTLYSIMQQSVQNLVKEIATLKKIDHFTFEKINDLLVPFLDLAFEMIGVEPYISSNSDIFSMSPSILSYMNQSKDFSDILEEIAEFLTSVKMNLEDMRSLAVAFNNETQTFSMDSVNLREEILGCLVPINNITNQMDFLYPNPISTHSGPQDIKWEIIHEVIPFLDKILSQNSTEIGSFLKMVICLTLEALWKNLKKDNWNVSNVLMTFTQHPNNLLKTIETVLEASSGIKSDYEGDLNKSLYFDTPLSQNITHHQLEKAIHNVLSRIALWRKGLLFNNSEWITSTRTLFQPLFEIFIKATTGKNVTSEKEERTKKEMIDFPYSFKPFFCLEKYLGGLFVLTKYWQQIPLTDQSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKVLFSALTVALSGKCDQEILHLLLTFPKGEKSWIAAEELCSLPGSKVYSLIVLLSRNLDVRAFIYKTLMPSEANGLLNSLLDIVSSLSALLAKAQHVFEYLPEFLHTFKITALLETLDFQQVSQNVQARSSAFGSFQFVMKMVCKDQASFLSDSNMFINLPRVKELLEDDKEKFNIPEDSTPFCLKLYQEILQLPNGALVWTFLKPILHGKILYTPNTPEINKVIQKANYTFYIVDKLKTLSETLLEMSSLFQRSGSGQMFNQLQEALRNKFVRNFVENQLHIDVDKLTEKLQTYGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDLFLNNVGFFFPLIMMLTWMVSVASMVRKLVYEQEIQIEEYMRMMGVHPVIHFLAWFLENMAVLTISSATLAIVLKTSGIFAHSNTFIVFLFLLDFGMSVVMLSYLLSAFFSQANTAALCTSLVYMISFLPYIVLLVLHNQLSFVNQTFLCLLSTTAFGQGVFFITFLEGQETGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNEDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 7586 - protein, 2366 aa, Homo sapiens
  Payload ID: 1601;
  Gene Symbol: ABCA13;
  Gene Name: ATP-binding cassette, sub-family A (ABC1), member 13;
  ENSP ID: ENSP00000442634
  MOD_RES (1)..(1): Any amino acid
XYPNPISTHSGPQDIKWEIIHEVIPFLDKILSQNSTEIGSFLKMVICLTLEALWKNLKKDNWNVSNVLMTFTQHPNNLLKTIETVLEASSGIKSDYEGDLNKSLYFDTPLSQNITHHQLEKAIHNVLSRIALWRKGLLFNNSEWITSTRTLFQPLFEIFIKATTGKNVTSEKEERTKKEMIDFPYSFKPFFCLEKYLGGLFVLTKYWQQIPLTDQSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKVLFSALTVALSGKCDQEILHLLLTFPKGEKSWIAAEELCSLPGSKVYSLIVLLSRNLDVRAFIYKTLMPSEANGLLNSLLDIVSSLSALLAKAQHVFEYLPEFLHTFKITALLETLDFQQVSQNVQARSSAFGSFQFVMKMVCKDQASFLSDSNMFINLPRVKELLEDDKEKFNIPEDSTPFCLKLYQEILQLPNGALVWTFLKPILHGKILYTPNTPEINKVIQKANYTFYIVDKLKTLSETLLEMSSLFQRSGSGQMFNQLQEALRNKFVRNFVENQLHIDVDKLTEKLQTYGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDLFLNNVGFFFPLIMMLTWMVSVASMVRKLVYEQEIQIEEYMRMMGVHPVIHFLAWFLENMAVLTISSATLAIVLKTSGIFAHSNTFIVFLFLLDFGMSVVMLSYLLSAFFSQANTAALCTSLVYMISFLPYIVLLVLHNQLSFVNQTFLCLLSTTAFGQGVFFITFLEGQETGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNEDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 7587 - protein, 2436 aa, Homo sapiens [sequence omitted]

SEQ ID NO: 7588 - protein, 2436 aa, Homo sapiens
  Payload ID: 1602;
  Gene Symbol: ABCA2;
  Gene Name: ATP-binding cassette, sub-family A (ABC1), member 2;
  Uniprot ID:  Q9BZC7;
  ENSP ID: ENSP00000344155
MGFLHQLQLLLWKNVTLKRRSPWVLAFEIFIPLVLFFILLGLRQKKPTISVKEVSFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 7589 - protein, 2435 aa, Homo sapiens
  Payload ID: 1602;
  Gene Symbol: ABCA2;
  Gene Name: ATP-binding cassette, sub-family A (ABC1), member 2;
  Uniprot ID:  Q9BZC7;
  ENSP ID: ENSP00000360666
MGFLHQLQLLLWKNVTLKRRSPWVLAFEIFIPLVLFFILLGLRQKKPTISVKEAFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 7590 - protein, 989 aa, Homo sapiens
  Payload ID: 1602;
  Gene Symbol: ABCA2;
  Gene Name: ATP-binding cassette, sub-family A (ABC1), member 2;
  ENSP ID: ENSP00000418662
MGRKTSRVQQGPPRSPACSAHGERSWGLEFPPFRWLLGIAGRTHLAALPPFQWVLAFEIFIPLVLFFILLGLRQKKPTISVKEAFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPEVLLAGQWADRSLGVELAVGTHPPPQCHGGGPGLCHGEPAL

SEQ ID NO: 7591 - protein, 1066 aa, Homo sapiens
  Payload ID: 1602;
  Gene Symbol: ABCA2;
  Gene Name: ATP-binding cassette, sub-family A (ABC1), member 2;
  ENSP ID: ENSP00000419850
FYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRLTACLASPPLPPACPGMGPSPLETS

SEQ ID NO: 7592 - protein, 1441 aa, Homo sapiens
  Payload ID: 1602;
  Gene Symbol: ABCA2;
  Gene Name: ATP-binding cassette, sub-family A (ABC1), member 2;
  ENSP ID: ENSP00000420084
  MOD_RES (1)..(1): Any amino acid
XGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVGSGHVGWGLGGVGQGQGGGAPAVEVEPGWAGP

SEQ ID NO: 7593 - protein, 44 aa, Homo sapiens
  Payload ID: 1602;
  Gene Symbol: ABCA2;
  Gene Name: ATP-binding cassette, sub-family A (ABC1), member 2;
  ENSP ID: ENSP00000420289
  MOD_RES (1)..(1): Any amino acid
XGAPSAAALATPDTLQGQCSAFVQLWAGLQPILCGNNRRCGGAT

SEQ ID NO: 7594 - protein, 195 aa, Homo sapiens
  Payload ID: 1602;
  Gene Symbol: ABCA2;
  Gene Name: ATP-binding cassette, sub-family A (ABC1), member 2;
  ENSP ID: ENSP00000420360
IKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNSDNLEQQETEPPSALQSPLGCLLSLLRPRSAPTELRALVADEPEDLDTEDEGLISFEEERAQLSFNTDTLC

SEQ ID NO: 7595 - protein, 2466 aa, Homo sapiens
  Payload ID: 1602;
  Gene Symbol: ABCA2;
  Gene Name: ATP-binding cassette, sub-family A (ABC1), member 2;
  ENSP ID: ENSP00000481105
MGRKTSRVQQGPPRSPACSAHGERSWGLEFPPFRWLLGIAGRTHLAALPPFQWVLAFEIFIPLVLFFILLGLRQKKPTISVKEVAFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 7596 - protein, 121 aa, Homo sapiens
  Payload ID: 1602;
  Gene Symbol: ABCA2;
  Gene Name: ATP-binding cassette, sub-family A (ABC1), member 2;
  ENSP ID: ENSP00000485459
MGRKTSRVQQGPPRSPACSAHGERSWGLEFPPFRWLLGIAGRTHLAALPPFQWVLAFEIFIPLVLFFILLGLRQKKPTISVKEVSFYTAAPLTSAGILPVMQSLCPDGQRDEFGFLQYANS

SEQ ID NO: 7597 - protein, 1704 aa, Homo sapiens
  Payload ID: 1603;
  Gene Symbol: ABCA3;
  Gene Name: ATP-binding cassette, sub-family A (ABC1), member 3;
  Uniprot ID:  Q99758;
  ENSP ID: ENSP00000301732
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 7598 - protein, 1646 aa, Homo sapiens
  Payload ID: 1603;
  Gene Symbol: ABCA3;
  Gene Name: ATP-binding cassette, sub-family A (ABC1), member 3;
  ENSP ID: ENSP00000371818
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 7599 - protein, 209 aa, Homo sapiens
  Payload ID: 1603;
  Gene Symbol: ABCA3;
  Gene Name: ATP-binding cassette, sub-family A (ABC1), member 3;
  Uniprot ID:  Q99758;
  ENSP ID: ENSP00000454397
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGEKLG

SEQ ID NO: 7600 - protein, 2273 aa, Homo sapiens [sequence omitted]

SEQ ID NO: 7601 - protein, 1065 aa, Homo sapiens
  Payload ID: 1604;
  Gene Symbol: ABCA4;
  Gene Name: ATP-binding cassette, sub-family A (ABC1), member 4;
  ENSP ID: ENSP00000439707
MDVVLHHVPEAKLVECIGQELIFLLPNKNFKHRAYASLFRELEETLADLGLSSFGISDTPLEEIFLKVTEDSDSGPLFAGGAQQKRENVNPRHPCLGPREKAGQTPQDSNVCSPGAPAAHPEGQPPPEPECPGPQLNTGTQLVLQHVQALLVKRFQHTIRSHKDFLAQIVLPATFVFLALMLSIVIPPFGEYPALTLHPWIYGQQYTFFSMDEPGSEQFTVLADVLLNKPGFGNRCLKEGWLPEYPCGNSTPWKTPSVSPNITQLFQKQKWTQVNPSPSCRCSTREKLTMLPECPEGAGGLPPPQRTQRSTEILQDLTDRNISDFLVKTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECFGLLGVNGAGKTTTFKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLDEPTTGMDPQARRMLWNVIVSIIREGRAVVLTSHSMEECEALCTRLAIMVKGAFRCMGTIQHLKSKFGDGYIVTMKIKSPKDDLLPDLNPVEQFFQGNFPGSVQRERHYNMLQFQVSSSSLARIFQLLLSHKDSLLIEEYSVTQTTLDQVFVNFAKQQTESHDLPLHPRAAGASRQAQD

SEQ ID NO: 7602 - protein, 1642 aa, Homo sapiens
  Payload ID: 1605;
  Gene Symbol: ABCA5;
  Gene Name: ATP-binding cassette, sub-family A (ABC1), member 5;
  Uniprot ID:  Q8WWZ7;
  ENSP ID: ENSP00000376443
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVFFALMLTPLFKKSKHVGIVEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGLFSALDSHSNLGVISYGVSMTTLEDVFLKLEVEAEIDQADYSVFTQQPLEEEMDSKSFDEMEQSLLILSETKAALVSTMSLWKQQMYTIAKFHFFTLKRESKSVRSVLLLLLIFFTVQIFMFLVHHSFKNAVVPIKLVPDLYFLKPGDKPHKYKTSLLLQNSADSDISDLISFFTSQNIMVTMINDSDYVSVAPHSAALNVMHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQVFVELTKEQEEEDNSCGTLNSTLWWERTQEDRVVF

SEQ ID NO: 7603 - protein, 573 aa, Homo sapiens
  Payload ID: 1605;
  Gene Symbol: ABCA5;
  Gene Name: ATP-binding cassette, sub-family A (ABC1), member 5;
  ENSP ID: ENSP00000465351
MPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQ

SEQ ID NO: 7604 - protein, 63 aa, Homo sapiens
  Payload ID: 1605;
  Gene Symbol: ABCA5;
  Gene Name: ATP-binding cassette, sub-family A (ABC1), member 5;
  ENSP ID: ENSP00000465766
MFLKSKWGIGYRLSMYIDKYCATESLSSLVKQHIPGATLLQQNDQQLVYSLPFKDMDKFSGIA

SEQ ID NO: 7605 - protein, 127 aa, Homo sapiens
  Payload ID: 1605;
  Gene Symbol: ABCA5;
  Gene Name: ATP-binding cassette, sub-family A (ABC1), member 5;
  ENSP ID: ENSP00000466662
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFV

SEQ ID NO: 7606 - protein, 192 aa, Homo sapiens
  Payload ID: 1605;
  Gene Symbol: ABCA5;
  Gene Name: ATP-binding cassette, sub-family A (ABC1), member 5;
  ENSP ID: ENSP00000466931
  MOD_RES (1)..(1): Any amino acid
XELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVSILTCDRNKELSKCLIT

SEQ ID NO: 7607 - protein, 431 aa, Homo sapiens
  Payload ID: 1605;
  Gene Symbol: ABCA5;
  Gene Name: ATP-binding cassette, sub-family A (ABC1), member 5;
  ENSP ID: ENSP00000467251
VEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGIA

SEQ ID NO: 7608 - protein, 917 aa, Homo sapiens
  Payload ID: 1605;
  Gene Symbol: ABCA5;
  Gene Name: ATP-binding cassette, sub-family A (ABC1), member 5;
  ENSP ID: ENSP00000467448
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVFFALMLTPLFKKSKHVGIVEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGLFSALDSHSNLGVISYGVSMTTLEDVFLKLEVEAEIDQADYSVFTQQPLEEEMDSKSFDEMEQSLLILSETKAALVSTMSLWKQQMYTIAKFHFFTLKRESKSVRSVLLLLLIFFTVQIFMFLVHHSFKNAVVPIKLVPDLYFLKPGDKPHKYKTSLLL

SEQ ID NO: 7609 - protein, 250 aa, Homo sapiens
  Payload ID: 1605;
  Gene Symbol: ABCA5;
  Gene Name: ATP-binding cassette, sub-family A (ABC1), member 5;
  ENSP ID: ENSP00000467524
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKE

SEQ ID NO: 7610 - protein, 38 aa, Homo sapiens
  Payload ID: 1605;
  Gene Symbol: ABCA5;
  Gene Name: ATP-binding cassette, sub-family A (ABC1), member 5;
  ENSP ID: ENSP00000467672
MSTAIREVGVWRQTRTLLLKNYLIKCRTKKSSVQEILF

SEQ ID NO: 7611 - protein, 250 aa, Homo sapiens; identical to SEQ ID NO: 7609
  Payload ID: 1605;
  Gene Symbol: ABCA5;
  Gene Name: ATP-binding cassette, sub-family A (ABC1), member 5;
  ENSP ID: ENSP00000467815

SEQ ID NO: 7612 - protein, 1642 aa, Homo sapiens; identical to SEQ ID NO: 7602
  Payload ID: 1605;
  Gene Symbol: ABCA5;
  Gene Name: ATP-binding cassette, sub-family A (ABC1), member 5;
  Uniprot ID:  Q8WWZ7;
  ENSP ID: ENSP00000467882

SEQ ID NO: 7613 - protein, 1617 aa, Homo sapiens
  Payload ID: 1606;
  Gene Symbol: ABCA6;
  Gene Name: ATP-binding cassette, sub-family A (ABC1), member 6;
  Uniprot ID:  Q8N139;
  ENSP ID: ENSP00000284425
MNMKQKSVYQQTKALLCKNFLKKWRMKRESLLEWGLSILLGLCIALFSSSMRNVQFPGMAPQNLGRVDKFNSSSLMVVYTPISNLTQQIMNKTALAPLLKGTSVIGAPNKTHMDEILLENLPYAMGIIFNETFSYKLIFFQGYNSPLWKEDFSAHCWDGYGEFSCTLTKYWNRGFVALQTAINTAIIEITTNHPVMEELMSVTAITMKTLPFITKNLLHNEMFILFFLLHFSPLVYFISLNVTKERKKSKNLMKMMGLQDSAFWLSWGLIYAGFIFIISIFVTIIITFTQIIVMTGFMVIFILFFLYGLSLVALVFLMSVLLKKAVLTNLVVFLLTLFWGCLGFTVFYEQLPSSLEWILNICSPFAFTTGMIQIIKLDYNLNGVIFPDPSGDSYTMIATFSMLLLDGLIYLLLALYFDKILPYGDERHYSPLFFLNSSSCFQHQRTNAKVIEKEIDAEHPSDDYFEPVAPEFQGKEAIRIRNVKKEYKGKSGKVEALKGLLFDIYEGQITAILGHSGAGKSSLLNILNGLSVPTEGSVTIYNKNLSEMQDLEEIRKITGVCPQFNVQFDILTVKENLSLFAKIKGIHLKEVEQEVQRILLELDMQNIQDNLAKHLSEGQKRKLTFGITILGDPQILLLDEPTTGLDPFSRDQVWSLLRERRADHVILFSTQSMDEADILADRKVIMSNGRLKCAGSSMFLKRRWGLGYHLSLHRNEICNPEQITSFITHHIPDAKLKTENKEKLVYTLPLERTNTFPDLFSDLDKCSDQGVTGYDISMSTLNEVFMKLEGQSTIEQDFEQVEMIRDSESLNEMELAHSSFSEMQTAVSDMGLWRMQVFAMARLRFLKLKRQTKVLLTLLLVFGIAIFPLIVENIMYAMLNEKIDWEFKNELYFLSPGQLPQEPRTSLLIINNTESNIEDFIKSLKHQNILLEVDDFENRNGTDGLSYNGAIIVSGKQKDYRFSVVCNTKRLHCFPILMNIISNGLLQMFNHTQHIRIESSPFPLSHIGLWTGLPDGSFFLFLVLCSISPYITMGSISDYKKNAKSQLWISGLYTSAYWCGQALVDVSFFILILLLMYLIFYIENMQYLLITSQIVFALVIVTPGYAASLVFFIYMISFIFRKRRKNSGLWSFYFFFASTIMFSITLINHFDLSILITTMVLVPSYTLLGFKTFLEVRDQEHYREFPEANFELSATDFLVCFIPYFQTLLFVFVLRCMELKCGKKRMRKDPVFRISPQSRDAKPNPEEPIDEDEDIQTERIRTATALTTSILDEKPVIIASCLHKEYAGQKKSCFSKRKKKIAARNISFCVQEGEILGLLGPNGAGKSSSIRMISGITKPTAGEVELKGCSSVLGHLGYCPQENVLWPMLTLREHLEVYAAVKGLRKADARLAIARLVSAFKLHEQLNVPVQKLTAGITRKLCFVLSLLGNSPVLLLDEPSTGIDPTGQQQMWQAIQAVVKNTERGVLLTTHNLAEAEALCDRVAIMVSGRLRCIGSIQHLKNKLGKDYILELKVKETSQVTLVHTEILKLFPQAAGQERYSSLLTYKLPVADVYPLSQTFHKLEAVKHNFNLEEYSLSQCTLEKVFLELSKEQEVGNFDEEIDTTMRWKLLPHSDEP

SEQ ID NO: 7614 - protein, 185 aa, Homo sapiens
  Payload ID: 1606;
  Gene Symbol: ABCA6;
  Gene Name: ATP-binding cassette, sub-family A (ABC1), member 6;
  Uniprot ID:  Q8N139;
  ENSP ID: ENSP00000466862
MNMKQKSVYQQTKALLCKNFLKKWRMKRESLLEWGLSILLGLCIALFSSSMRNVQFPGMAPQNLGRVDKFNSSSLMVVYTPISNLTQQIMNKTALAPLLKGTSVIGAPNKTHMDEILLENLPYAMGIIFNETFSYKLIFFQGYNSPLWKEDFSGDFPYQISLWNFSCFQHKEQRRLGNRDAFNDT

SEQ ID NO: 7615 - protein, 2146 aa, Homo sapiens
  Payload ID: 1607;
  Gene Symbol: ABCA7;
  Gene Name: ATP-binding cassette, sub-family A (ABC1), member 7;
  Uniprot ID:  Q8IZY2;
  ENSP ID: ENSP00000263094
MAFWTQLMLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLLRTESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSRPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGPARHAHSITTLNHPLNLTKEQLSEGALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGAELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 7616 - protein, 2146 aa, Homo sapiens; identical to SEQ ID NO: 7615
  Payload ID: 1607;
  Gene Symbol: ABCA7;
  Gene Name: ATP-binding cassette, sub-family A (ABC1), member 7;
  Uniprot ID:  Q8IZY2;
  ENSP ID: ENSP00000414062

SEQ ID NO: 7617 - protein, 164 aa, Homo sapiens
  Payload ID: 1607;
  Gene Symbol: ABCA7;
  Gene Name: ATP-binding cassette, sub-family A (ABC1), member 7;
  ENSP ID: ENSP00000431473
MAFWTQLMLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLL

SEQ ID NO: 7618 - protein, 591 aa, Homo sapiens
  Payload ID: 1607;
  Gene Symbol: ABCA7;
  Gene Name: ATP-binding cassette, sub-family A (ABC1), member 7;
  ENSP ID: ENSP00000432031
  MOD_RES (1)..(1): Any amino acid
XSICVVFAMSFVPASFTLVLIEERVTRAKHLQLMGGLSPTLYWLGNFLWDMCNYLVPACIVVLIFLAFQQRAYVAPANLPALLLLLLLYGTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGAELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 7619 - protein, 136 aa, Homo sapiens
  Payload ID: 1607;
  Gene Symbol: ABCA7;
  Gene Name: ATP-binding cassette, sub-family A (ABC1), member 7;
  ENSP ID: ENSP00000433545
MAFWTQLMLLLWKNFMYRRRQPLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARST

SEQ ID NO: 7620 - protein, 62 aa, Homo sapiens
  Payload ID: 1607;
  Gene Symbol: ABCA7;
  Gene Name: ATP-binding cassette, sub-family A (ABC1), member 7;
  ENSP ID: ENSP00000437311
  MOD_RES (1)..(1): Any amino acid
XPQETALENGEPAGSAPETDQGSGPDAVGRVQGWALTRQQLQALLLKRFLLARRSRRGLFAQ

SEQ ID NO: 7621 - protein, 2008 aa, Homo sapiens
  Payload ID: 1607;
  Gene Symbol: ABCA7;
  Gene Name: ATP-binding cassette, sub-family A (ABC1), member 7;
  Uniprot ID:  Q8IZY2;
  ENSP ID: ENSP00000465322
MVCLGTGQSAGPLVSVQNHCPPCGLSPQESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSRPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGPARHAHSITTLNHPLNLTKEQLSEGALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGAELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 7622 - protein, 36 aa, Homo sapiens
  Payload ID: 1607;
  Gene Symbol: ABCA7;
  Gene Name: ATP-binding cassette, sub-family A (ABC1), member 7;
  ENSP ID: ENSP00000478857
MAFWTQLMLLLWKNFMYRRRQPVQLLVELLWPLFLF

SEQ ID NO: 7623 - protein, 96 aa, Homo sapiens
  Payload ID: 1607;
  Gene Symbol: ABCA7;
  Gene Name: ATP-binding cassette, sub-family A (ABC1), member 7;
  ENSP ID: ENSP00000480811
  MOD_RES (1)..(1): Any amino acid
XLVSICVVFAMSFVPASFTLVLIEERVTRAKHLQLMGGLSPTLYWLGNFLWDMCNYLVPACIVVLIFLAFQQRAYVAPANLPALLLLLLLYGSCRR

SEQ ID NO: 7624 - protein, 280 aa, Homo sapiens
  Payload ID: 1607;
  Gene Symbol: ABCA7;
  Gene Name: ATP-binding cassette, sub-family A (ABC1), member 7;
  ENSP ID: ENSP00000482948
REPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGAELREAHGGRLRFQLPPGGRCALARVFGELAVHGAEHGVEDFSVSQTMLEEDQGKDEDTEEQKEAGVGVDPAPGLQHPKRVSQFLDDPSTAETVL

SEQ ID NO: 7625 - protein, 1581 aa, Homo sapiens
  Payload ID: 1608;
  Gene Symbol: ABCA8;
  Gene Name: ATP-binding cassette, sub-family A (ABC1), member 8;
  Uniprot ID:  O94911;
  ENSP ID: ENSP00000269080
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 7626 - protein, 1616 aa, Homo sapiens
  Payload ID: 1608;
  Gene Symbol: ABCA8;
  Gene Name: ATP-binding cassette, sub-family A (ABC1), member 8;
  ENSP ID: ENSP00000402814
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIQRVLLELEMKNIQDVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 7627 - protein, 115 aa, Homo sapiens
  Payload ID: 1608;
  Gene Symbol: ABCA8;
  Gene Name: ATP-binding cassette, sub-family A (ABC1), member 8;
  ENSP ID: ENSP00000466126
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKE

SEQ ID NO: 7628 - protein, 702 aa, Homo sapiens
  Payload ID: 1608;
  Gene Symbol: ABCA8;
  Gene Name: ATP-binding cassette, sub-family A (ABC1), member 8;
  ENSP ID: ENSP00000467186
  MOD_RES (1)..(1): Any amino acid
XPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIQRVLLELEMKNIQDVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLEVNIYNLTIPDSPLSGISQITLLSAGILFLLSKPLHNKLTFGL

SEQ ID NO: 7629 - protein, 1621 aa, Homo sapiens
  Payload ID: 1608;
  Gene Symbol: ABCA8;
  Gene Name: ATP-binding cassette, sub-family A (ABC1), member 8;
  Uniprot ID:  O94911;
  ENSP ID: ENSP00000467271
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIQRVLLELEMKNIQDVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 7630 - protein, 156 aa, Homo sapiens
  Payload ID: 1608;
  Gene Symbol: ABCA8;
  Gene Name: ATP-binding cassette, sub-family A (ABC1), member 8;
  ENSP ID: ENSP00000481467
MLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILVTVELESQHC

SEQ ID NO: 7631 - protein, 1624 aa, Homo sapiens
  Payload ID: 1609;
  Gene Symbol: ABCA9;
  Gene Name: ATP-binding cassette, sub-family A (ABC1), member 9;
  Uniprot ID:  Q8IUA7;
  ENSP ID: ENSP00000342216
MSKRRMSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFWLSWGLMYAGFILIMATLMALIVKSAQIVVLTGFVMVFTLFLLYGLSLITLAFLMSVLIKKPFLTGLVVFLLIVFWGILGFPALYTRLPAFLEWTLCLLSPFAFTVGMAQLIHLDYDVNSNAHLDSSQNPYLIIATLFMLVFDTLLYLVLTLYFDKILPAEYGHRCSPLFFLKSCFWFQHGRANHVVLENETDSDPTPNDCFEPVSPEFCGKEAIRIKNLKKEYAGKCERVEALKGVVFDIYEGQITALLGHSGAGKTTLLNILSGLSVPTSGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLKLKKERKSLWTILLLFGISFIPQLLEHLFYESYQKSYPWELSPNTYFLSPGQQPQDPLTHLLVINKTGSTIDNFLHSLRRQNIAIEVDAFGTRNGTDDPSYNGAIIVSGDEKDHRFSIACNTKRLNCFPVLLDVISNGLLGIFNSSEHIQTDRSTFFEEHMDYEYGYRSNTFFWIPMAASFTPYIAMSSIGDYKKKAHSQLRISGLYPSAYWFGQALVDVSLYFLILLLMQIMDYIFSPEEIIFIIQNLLIQILCSIGYVSSLVFLTYVISFIFRNGRKNSGIWSFFFLIVVIFSIVATDLNEYGFLGLFFGTMLIPPFTLIGSLFIFSEISPDSMDYLGASESEIVYLALLIPYLHFLIFLFILRCLEMNCRKKLMRKDPVFRISPRSNAIFPNPEEPEGEEEDIQMERMRTVNAMAVRDFDETPVIIASCLRKEYAGKKKNCFSKRKKKIATRNVSFCVKKGEVIGLLGHNGAGKSTTIKMITGDTKPTAGQVILKGSGGGEPLGFLGYCPQENALWPNLTVRQHLEVYAAVKGLRKGDAMIAITRLVDALKLQDQLKAPVKTLSEGIKRKLCFVLSILGNPSVVLLDEPSTGMDPEGQQQMWQVIRATFRNTERGALLTTHYMAEAEAVCDRVAIMVSGRLRCIGSIQHLKSKFGKDYLLEMKLKNLAQMEPLHAEILRLFPQAAQQERFSSLMVYKLPVEDVRPLSQAFFKLEIVKQSFDLEEYSLSQSTLEQVFLELSKEQELGDLEEDFDPSVKWKLLLQEEP

SEQ ID NO: 7632 - protein, 1586 aa, Homo sapiens
  Payload ID: 1609;
  Gene Symbol: ABCA9;
  Gene Name: ATP-binding cassette, sub-family A (ABC1), member 9;
  ENSP ID: ENSP00000394264
MSKRRMSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFWLSWGLMYAGFILIMATLMALIVKSAQIVVLTGFVMVFTLFLLYGLSLITLAFLMSVLIKKPFLTGLVVFLLIVFWGILGFPALYTRLPAFLEWTLCLLSPFAFTVGMAQLIHLDYDVNSNAHLDSSQNPYLIIATLFMLVFDTLLYLVLTLYFDKILPAEYGHRCSPLFFLKSCFWFQHGRANHVVLENETDSDPTPNDCFEPVSPEFCGKEAIRIKNLKKEYAGKCERVEALKGVVFDIYEGQITALLGHSGAGKTTLLNILSGLSVPTSGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLKLKKERKSLWTILLLFGISFIPQLLEHLFYESYQKSYPWELSPNTYFLSPGQQPQDPLTHLLVINKTGSTIDNFLHSLRRQNIAIEVDAFGTRNGTDDPSYNGAIIVSGDEKDHRFSIACNTKRLNCFPVLLDVISNGLLGIFNSSEHIQTDRSTFFEEHMDYEYGYRSNTFFWIPMAASFTPYIAMSSIGDYKKKAHSQLRISGLYPSAYWFGQALVDVSLYFLILLLMQIMDYIFSPEEIIFIIQNLLIQVVIFSIVATDLNEYGFLGLFFGTMLIPPFTLIGSLFIFSEISPDSMDYLGASESEIVYLALLIPYLHFLIFLFILRCLEMNCRKKLMRKDPVFRISPRSNAIFPNPEEPEGEEEDIQMERMRTVNAMAVRDFDETPVIIASCLRKEYAGKKKNCFSKRKKKIATRNVSFCVKKGEVIGLLGHNGAGKSTTIKMITGDTKPTAGQVILKGSGGGEPLGFLGYCPQENALWPNLTVRQHLEVYAAVKGLRKGDAMIAITRLVDALKLQDQLKAPVKTLSEGIKRKLCFVLSILGNPSVVLLDEPSTGMDPEGQQQMWQVIRATFRNTERGALLTTHYMAEAEAVCDRVAIMVSGRLRCIGSIQHLKSKFGKDYLLEMKLKNLAQMEPLHAEILRLFPQAAQQERFSSLMVYKLPVEDVRPLSQAFFKLEIVKQSFDLEEYSLSQSTLEQVFLELSKEQELGDLEEDFDPSVKWKLLLQEEP

SEQ ID NO: 7633 - protein, 89 aa, Homo sapiens
  Payload ID: 1609;
  Gene Symbol: ABCA9;
  Gene Name: ATP-binding cassette, sub-family A (ABC1), member 9;
  ENSP ID: ENSP00000465191
MSKRRMSVGQQTWALLCKNCLKKWRMKRQTLLEWLFSFLLVLFLYLFFSNLHQVHDTPQMSSMDLGRVDSFNDTNYVIAFAPESKTTQE

SEQ ID NO: 7634 - protein, 267 aa, Homo sapiens
  Payload ID: 1609;
  Gene Symbol: ABCA9;
  Gene Name: ATP-binding cassette, sub-family A (ABC1), member 9;
  Uniprot ID:  Q8IUA7;
  ENSP ID: ENSP00000465601
MSKRRMSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFW

SEQ ID NO: 7635 - protein, 1280 aa, Homo sapiens
  Payload ID: 1610;
  Gene Symbol: ABCB1;
  Gene Name: ATP-binding cassette, sub-family B (MDR/TAP), member 1;
  Uniprot ID:  P08183;
  ENSP ID: ENSP00000265724
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTRYAYYYSGIGAGVLVAAYIQVSFWCLAAGRQIHKIRKQFFHAIMRQEIGWFDVHDVGELNTRLTDDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 7636 - protein, 48 aa, Homo sapiens
  Payload ID: 1610;
  Gene Symbol: ABCB1;
  Gene Name: ATP-binding cassette, sub-family B (MDR/TAP), member 1;
  ENSP ID: ENSP00000399419
MDLEGDRNGGAKKKNFFKLNNKSEKDKKEKKPTVSVFSMFRYSNWLDK

SEQ ID NO: 7637 - protein, 1216 aa, Homo sapiens
  Payload ID: 1610;
  Gene Symbol: ABCB1;
  Gene Name: ATP-binding cassette, sub-family B (MDR/TAP), member 1;
  Uniprot ID:  P08183;
  ENSP ID: ENSP00000444095
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTSDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 7638 - protein, 1280 aa, Homo sapiens; identical to SEQ ID NO: 7635
  Payload ID: 1610;
  Gene Symbol: ABCB1;
  Gene Name: ATP-binding cassette, sub-family B (MDR/TAP), member 1;
  Uniprot ID:  P08183;
  ENSP ID: ENSP00000478255

SEQ ID NO: 7639 - protein, 738 aa, Homo sapiens
  Payload ID: 1611;
  Gene Symbol: ABCB10;
  Gene Name: ATP-binding cassette, sub-family B (MDR/TAP), member 10;
  Uniprot ID:  Q9NRK6;
  ENSP ID: ENSP00000355637
MRGPPAWPLRLLEPPSPAEPGRLLPVACVWAAASRVPGSLSPFTGLRPARLWGAGPALLWGVGAARRWRSGCRGGGPGASRGVLGLARLLGLWARGPGSCRCGAFAGPGAPRLPRARFPGGPAAAAWAGDEAWRRGPAAPPGDKGRLRPAAAGLPEARKLLGLAYPERRRLAAAVGFLTMSSVISMSAPFFLGKIIDVIYTNPTVDYSDNLTRLCLGLSAVFLCGAAANAIRVYLMQTSGQRIVNRLRTSLFSSILRQEVAFFDKTRTGELINRLSSDTALLGRSVTENLSDGLRAGAQASVGISMMFFVSPNLATFVLSVVPPVSIIAVIYGRYLRKLTKVTQDSLAQATQLAEERIGNVRTVRAFGKEMTEIEKYASKVDHVMQLARKEAFARAGFFGATGLSGNLIVLSVLYKGGLLMGSAHMTVGELSSFLMYAFWVGISIGGLSSFYSELMKGLGAGGRLWELLEREPKLPFNEGVILNEKSFQGALEFKNVHFAYPARPEVPIFQDFSLSIPSGSVTALVGPSGSGKSTVLSLLLRLYDPASGTISLDGHDIRQLNPVWLRSKIGTVSQEPILFSCSIAENIAYGADDPSSVTAEEIQRVAEVANAVAFIRNFPQGFNTVVGEKGVLLSGGQKQRIAIARALLKNPKILLLDEATSALDAENEYLVQEALDRLMDGRTVLVIAHRLSTIKNANMVAVLDQGKITEYGKHEELLSKPNGIYRKLMNKQSFISA

SEQ ID NO: 7640 - protein, 1321 aa, Homo sapiens
  Payload ID: 1612;
  Gene Symbol: ABCB11;
  Gene Name: ATP-binding cassette, sub-family B (MDR/TAP), member 11;
  Uniprot ID:  O95342;
  ENSP ID: ENSP00000263817
MSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRKPIIDCMSEDGYKLDRIKGEIEFHNVTFHYPSRPEVKILNDLNMVIKPGEMTALVGPSGAGKSTALQLIQRFYDPCEGMVTVDGHDIRSLNIQWLRDQIGIVEQEPVLFSTTIAENIRYGREDATMEDIVQAAKEANAYNFIMDLPQQFDTLVGEGGGQMSGGQKQRVAIARALIRNPKILLLDMATSALDNESEAMVQEVLSKIQHGHTIISVAHRLSTVRAADTIIGFEHGTAVERGTHEELLERKGVYFTLVTLQSQGNQALNEEDIKDATEDDMLARTFSRGSYQDSLRASIRQRSKSQLSYLVHEPPLAVVDHKSTYEEDRKDKDIPVQEEVEPAPVRRILKFSAPEWPYMLVGSVGAAVNGTVTPLYAFLFSQILGTFSIPDKEEQRSQINGVCLLFVAMGCVSLFTQFLQGYAFAKSGELLTKRLRKFGFRAMLGQDIAWFDDLRNSPGALTTRLATDASQVQGAAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 7641 - protein, 72 aa, Homo sapiens
  Payload ID: 1612;
  Gene Symbol: ABCB11;
  Gene Name: ATP-binding cassette, sub-family B (MDR/TAP), member 11;
  ENSP ID: ENSP00000416058
DIRSLNIQWLRDQIGIVEQEPVLFSTTIAENIRYGREDATMEDIVQAAKEANAYNFIMDLPQGYFFQWKSEQ

SEQ ID NO: 7642 - protein, 451 aa, Homo sapiens
  Payload ID: 1612;
  Gene Symbol: ABCB11;
  Gene Name: ATP-binding cassette, sub-family B (MDR/TAP), member 11;
  ENSP ID: ENSP00000480206
AAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 7643 - protein, 1286 aa, Homo sapiens
  Payload ID: 1613;
  Gene Symbol: ABCB4;
  Gene Name: ATP-binding cassette, sub-family B (MDR/TAP), member 4;
  Uniprot ID:  P21439;
  ENSP ID: ENSP00000265723
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVFVDFGFQLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 7644 - protein, 1232 aa, Homo sapiens
  Payload ID: 1613;
  Gene Symbol: ABCB4;
  Gene Name: ATP-binding cassette, sub-family B (MDR/TAP), member 4;
  Uniprot ID:  P21439;
  ENSP ID: ENSP00000351172
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 7645 - protein, 1279 aa, Homo sapiens
  Payload ID: 1613;
  Gene Symbol: ABCB4;
  Gene Name: ATP-binding cassette, sub-family B (MDR/TAP), member 4;
  Uniprot ID:  P21439;
  ENSP ID: ENSP00000352135
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 7646 - protein, 1232 aa, Homo sapiens; identical to SEQ ID NO: 7644
  Payload ID: 1613;
  Gene Symbol: ABCB4;
  Gene Name: ATP-binding cassette, sub-family B (MDR/TAP), member 4;
  Uniprot ID:  P21439;
  ENSP ID: ENSP00000392983

SEQ ID NO: 7647 - protein, 61 aa, Homo sapiens
  Payload ID: 1613;
  Gene Symbol: ABCB4;
  Gene Name: ATP-binding cassette, sub-family B (MDR/TAP), member 4;
  ENSP ID: ENSP00000394511
MDLEAAKNGTAWRPTSAEGDFELGISSKQKRKKTKTVKMIGVLTLFRYSDWQDKLFMSLGT

SEQ ID NO: 7648 - protein, 99 aa, Homo sapiens
  Payload ID: 1613;
  Gene Symbol: ABCB4;
  Gene Name: ATP-binding cassette, sub-family B (MDR/TAP), member 4;
  ENSP ID: ENSP00000395716
  MOD_RES (1)..(1): Any amino acid
XIRQPQILLLDEATSALDTESEKVVQEALDKAREGRTCIVIAHRLSTIQNADLIVVFQNGRVKEHGTHQQLLAQKGIYFSMINLEDPIWGLLRHLKFES

SEQ ID NO: 7649 - protein, 812 aa, Homo sapiens
  Payload ID: 1614;
  Gene Symbol: ABCB5;
  Gene Name: ATP-binding cassette, sub-family B (MDR/TAP), member 5;
  Uniprot ID:  Q2M3G0;
  ENSP ID: ENSP00000258738
MVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKASKGRTTIVVAHRLSTIRSADLIVTLKDGMLAEKGAHAELMAKRGLYYSLVMSQDIKKADEQMESMTYSTERKTNSLPLHSVKSIKSDFIDKAEESTQSKEISLPEVSLLKILKLNKPEWPFVVLGTLASVLNGTVHPVFSIIFAKIITMFGNNDKTTLKHDAEIYSMIFVILGVICFVSYFMQGLFYGRAGEILTMRLRHLAFKAMLYQDIAWFDEKENSTGGLTTILAIDIAQIQGATGSRIGVLTQNATNMGLSVIISFIYGWEMTFLILSIAPVLAVTGMIETAAMTGFANKDKQELKHAGKIATEALENIRTIVSLTREKAFEQMYEEMLQTQHRNTSKKAQIIGSCYAFSHAFIYFAYAAGFRFGAYLIQAGRMTPEGMFIVFTAIAYGAMAIGETLVLAPEYSKAKSGAAHLFALLEKKPNIDSRSQEGKKPDTCEGNLEFREVSFFYPCRPDVFILRGLSLSIERGKTVAFVGSSGCGKSTSVQLLQRLYDPVQGQVLFDGVDAKELNVQWLRSQIAIVPQEPVLFNCSIAENIAYGDNSRVVPLDEIKEAANAANIHSFIEGLPEKYNTQVGLKGAQLSGGQKQRLAIARALLQKPKILLLDEATSALDNDSEKVVQHALDKARTGRTCLVVTHRLSAIQNADLIVVLHNGKIKEQGTHQELLRNRDIYFKLVNAQSVQ

SEQ ID NO: 7650 - protein, 126 aa, Homo sapiens
  Payload ID: 1614;
  Gene Symbol: ABCB5;
  Gene Name: ATP-binding cassette, sub-family B (MDR/TAP), member 5;
  Uniprot ID:  Q2M3G0;
  ENSP ID: ENSP00000383899
MVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKKK

SEQ ID NO: 7651 - protein, 1257 aa, Homo sapiens
  Payload ID: 1614;
  Gene Symbol: ABCB5;
  Gene Name: ATP-binding cassette, sub-family B (MDR/TAP), member 5;
  Uniprot ID:  Q2M3G0;
  ENSP ID: ENSP00000384881
MENSERAEEMQENYQRNGTAEEQPKLRKEAVGSIEIFRFADGLDITLMILGILASLVNGACLPLMPLVLGEMSDNLISGCLVQTNTTNYQNCTQSQEKLNEDMTLLTLYYVGIGVAALIFGYIQISLWIITAARQTKRIRKQFFHSVLAQDIGWFDSCDIGELNTRMTDDIDKISDGIGDKIALLFQNMSTFSIGLAVGLVKGWKLTLVTLSTSPLIMASAAACSRMVISLTSKELSAYSKAGAVAEEVLSSIRTVIAFRAQEKELQRYTQNLKDAKDFGIKRTIASKVSLGAVYFFMNGTYGLAFWYGTSLILNGEPGYTIGTVLAVFFSVIHSSYCIGAAVPHFETFAIARGAAFHIFQVIDKKPSIDNFSTAGYKPESIEGTVEFKNVSFNYPSRPSIKILKGLNLRIKSGETVALVGLNGSGKSTVVQLLQRLYDPDDGFIMVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKASKGRTTIVVAHRLSTIRSADLIVTLKDGMLAEKGAHAELMAKRGLYYSLVMSQDIKKADEQMESMTYSTERKTNSLPLHSVKSIKSDFIDKAEESTQSKEISLPEVSLLKILKLNKPEWPFVVLGTLASVLNGTVHPVFSIIFAKIITMFGNNDKTTLKHDAEIYSMIFVILGVICFVSYFMQGLFYGRAGEILTMRLRHLAFKAMLYQDIAWFDEKENSTGGLTTILAIDIAQIQGATGSRIGVLTQNATNMGLSVIISFIYGWEMTFLILSIAPVLAVTGMIETAAMTGFANKDKQELKHAGKIATEALENIRTIVSLTREKAFEQMYEEMLQTQHRNTSKKAQIIGSCYAFSHAFIYFAYAAGFRFGAYLIQAGRMTPEGMFIVFTAIAYGAMAIGETLVLAPEYSKAKSGAAHLFALLEKKPNIDSRSQEGKKPDTCEGNLEFREVSFFYPCRPDVFILRGLSLSIERGKTVAFVGSSGCGKSTSVQLLQRLYDPVQGQVLFDGVDAKELNVQWLRSQIAIVPQEPVLFNCSIAENIAYGDNSRVVPLDEIKEAANAANIHSFIEGLPEKYNTQVGLKGAQLSGGQKQRLAIARALLQKPKILLLDEATSALDNDSEKVVQHALDKARTGRTCLVVTHRLSAIQNADLIVVLHNGKIKEQGTHQELLRNRDIYFKLVNAQSVQ

SEQ ID NO: 7652 - protein, 314 aa, Homo sapiens
  Payload ID: 1614;
  Gene Symbol: ABCB5;
  Gene Name: ATP-binding cassette, sub-family B (MDR/TAP), member 5;
  ENSP ID: ENSP00000398692
GWEMTFLILSIAPVLAVTGMIETAAMTGFANKDKQELKHAGKIATEALENIRTIVSLTREKAFEQMYEEMLQTQHRNTSKKAQIIGSCYAFSHAFIYFAYAAGFRFGAYLIQAGRMTPEGMFIVFTAIAYGAMAIGETLVLAPEYSKAKSGAAHLFALLEKKPNIDSRSQEGKKPDTCEGNLEFREVSFFYPCRPDVFILRGLSLSIERGKTVAFVGSSGCGKSTSVQLLQRLYDPVQGQVLFDGVDAKELNVQWLRSQIAIVPQEPVLFNCSIAENIAYGDNSRVVPLDEIKEAANAANIHSFIEGLPESLEC

SEQ ID NO: 7653 - protein, 131 aa, Homo sapiens
  Payload ID: 1614;
  Gene Symbol: ABCB5;
  Gene Name: ATP-binding cassette, sub-family B (MDR/TAP), member 5;
  Uniprot ID:  Q2M3G0;
  ENSP ID: ENSP00000406730
MVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKDTPRYSF

SEQ ID NO: 7654 - protein, 842 aa, Homo sapiens
  Payload ID: 1615;
  Gene Symbol: ABCB6;
  Gene Name: ATP-binding cassette, sub-family B (MDR/TAP), member 6 (Langereis blood group);
  Uniprot ID:  Q9NP58;
  ENSP ID: ENSP00000265316
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 7655 - protein, 690 aa, Homo sapiens
  Payload ID: 1615;
  Gene Symbol: ABCB6;
  Gene Name: ATP-binding cassette, sub-family B (MDR/TAP), member 6 (Langereis blood group);
  ENSP ID: ENSP00000295750
  MOD_RES (1)..(1): Any amino acid
XLLASVLESLAGACGLWLLVVERSQARQRLAMGIWIKFRHSPGLLLLWTVAFAAENLALVSWNSPQWWWARADLGQQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 7656 - protein, 147 aa, Homo sapiens
  Payload ID: 1615;
  Gene Symbol: ABCB6;
  Gene Name: ATP-binding cassette, sub-family B (MDR/TAP), member 6 (Langereis blood group);
  ENSP ID: ENSP00000392988
  MOD_RES (1)..(1): Any amino acid
XAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQ

SEQ ID NO: 7657 - protein, 68 aa, Homo sapiens
  Payload ID: 1615;
  Gene Symbol: ABCB6;
  Gene Name: ATP-binding cassette, sub-family B (MDR/TAP), member 6 (Langereis blood group);
  ENSP ID: ENSP00000401811
NLALVSWNSPQWWWARADLGQQVQFSLWVLRYVVSGGLFVLGLWAPGLRPQSYTLQVHEEDQDVERSQ

SEQ ID NO: 7658 - protein, 119 aa, Homo sapiens
  Payload ID: 1615;
  Gene Symbol: ABCB6;
  Gene Name: ATP-binding cassette, sub-family B (MDR/TAP), member 6 (Langereis blood group);
  ENSP ID: ENSP00000404006
  MOD_RES (1)..(1): Any amino acid
XGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQP

SEQ ID NO: 7659 - protein, 40 aa, Homo sapiens
  Payload ID: 1615;
  Gene Symbol: ABCB6;
  Gene Name: ATP-binding cassette, sub-family B (MDR/TAP), member 6 (Langereis blood group);
  ENSP ID: ENSP00000414646
  MOD_RES (1)..(1): Any amino acid
XADNIRYGRVTAGNDEVEAAAQAAGIHDAIMAFPEETCGG

SEQ ID NO: 7660 - protein, 753 aa, Homo sapiens
  Payload ID: 1616;
  Gene Symbol: ABCB7;
  Gene Name: ATP-binding cassette, sub-family B (MDR/TAP), member 7;
  Uniprot ID:  O75027;
  ENSP ID: ENSP00000253577
MALLAMHSWRWAAAAAAFEKRRHSAILIRPLVSVSGSGPQWRPHQLGALGTARAYQQIPESLKSITWQRLGKGNSGQFLDAAKALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 7661 - protein, 712 aa, Homo sapiens
  Payload ID: 1616;
  Gene Symbol: ABCB7;
  Gene Name: ATP-binding cassette, sub-family B (MDR/TAP), member 7;
  Uniprot ID:  O75027;
  ENSP ID: ENSP00000343849
MALLAMHSWRWAAAAAAFEKRRHSAILIRPLVSVSGSGPQWRPHQLGALGTARAYQIPESLKSITWQRLGKGNSGQFLDAAKALQVWPLIEKRTCWHGHAGGGLHTDPKEGAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 7662 - protein, 752 aa, Homo sapiens
  Payload ID: 1616;
  Gene Symbol: ABCB7;
  Gene Name: ATP-binding cassette, sub-family B (MDR/TAP), member 7;
  Uniprot ID:  O75027;
  ENSP ID: ENSP00000362492
MALLAMHSWRWAAAAAAFEKRRHSAILIRPLVSVSGSGPQWRPHQLGALGTARAYQIPESLKSITWQRLGKGNSGQFLDAAKALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 7663 - protein, 171 aa, Homo sapiens
  Payload ID: 1616;
  Gene Symbol: ABCB7;
  Gene Name: ATP-binding cassette, sub-family B (MDR/TAP), member 7;
  ENSP ID: ENSP00000432813
MERGERDIELEEMALLAMHSWRWAAAAAAFEKRRHSAILIRPLVSVSGSGPQWRPHQLGALGTARAYQQIPESLKSITWQRLGKGNSGQFLDAAKALQVWPLIEKRTCWHGHAGGGLHTDPKEGLKDVDTRKIIKAMLSYVWPKDRPDLRARVAISLGFLGGAKAMNIVVP

SEQ ID NO: 7664 - protein, 188 aa, Homo sapiens
  Payload ID: 1616;
  Gene Symbol: ABCB7;
  Gene Name: ATP-binding cassette, sub-family B (MDR/TAP), member 7;
  ENSP ID: ENSP00000435521
MALLAMHSWRWAAAAAAFEKRRHSAILIRPLVSVSGSGPQWRPHQLGALGTARAYQLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLS

SEQ ID NO: 7665 - protein, 702 aa, Homo sapiens
  Payload ID: 1616;
  Gene Symbol: ABCB7;
  Gene Name: ATP-binding cassette, sub-family B (MDR/TAP), member 7;
  ENSP ID: ENSP00000436586
MALLAMHSWRWAAAAAAFEKRRHSAILIRPLVSVSGSGPQWRPHQLGALGTARAYQALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENIS

SEQ ID NO: 7666 - protein, 713 aa, Homo sapiens
  Payload ID: 1616;
  Gene Symbol: ABCB7;
  Gene Name: ATP-binding cassette, sub-family B (MDR/TAP), member 7;
  ENSP ID: ENSP00000479985
MALLAMHSWRWAAAAAAFEKRRHSAILIRPLVSVSGSGPQWRPHQLGALGTARAYQQIPESLKSITWQRLGKGNSGQFLDAAKALQVWPLIEKRTCWHGHAGGGLHTDPKEGAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 7667 - protein, 735 aa, Homo sapiens
  Payload ID: 1617;
  Gene Symbol: ABCB8;
  Gene Name: ATP-binding cassette, sub-family B (MDR/TAP), member 8;
  Uniprot ID:  Q9NUT2;
  ENSP ID: ENSP00000297504
MLVHLFRVGIRGGPFPGRLLPPLRFQTFSAVRNTWRNGKTGQLHKAEGEYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 7668 - protein, 718 aa, Homo sapiens
  Payload ID: 1617;
  Gene Symbol: ABCB8;
  Gene Name: ATP-binding cassette, sub-family B (MDR/TAP), member 8;
  Uniprot ID:  Q9NUT2;
  ENSP ID: ENSP00000351717
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 7669 - protein, 148 aa, Homo sapiens
  Payload ID: 1617;
  Gene Symbol: ABCB8;
  Gene Name: ATP-binding cassette, sub-family B (MDR/TAP), member 8;
  ENSP ID: ENSP00000417563
MLVHLFRVGIRGGPFPGRLLPPLRFQTFSAVRRLLRLQPRVSQKEGTLGVSDHAQSALPTGGPLSWPWRYSDGYRSSSLLRAVAHLRSQLWAHLPRAPLAPRWSPSAWCWVGGALLGPMVLSKHPHLCLVALCEAEEAPPASSTPHVV

SEQ ID NO: 7670 - protein, 693 aa, Homo sapiens
  Payload ID: 1617;
  Gene Symbol: ABCB8;
  Gene Name: ATP-binding cassette, sub-family B (MDR/TAP), member 8;
  Uniprot ID:  Q9NUT2;
  ENSP ID: ENSP00000418271
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLAGTHEELLKKGGLYAELIRRQALDAPRTAAPPPKKPEGPRSHQHKS

SEQ ID NO: 7671 - protein, 48 aa, Homo sapiens
  Payload ID: 1617;
  Gene Symbol: ABCB8;
  Gene Name: ATP-binding cassette, sub-family B (MDR/TAP), member 8;
  ENSP ID: ENSP00000418316
MLVHLFRVGIRGGPFPGRLLPPLRFQTFSAVSCGEGVCVMAPQAREGR

SEQ ID NO: 7672 - protein, 58 aa, Homo sapiens
  Payload ID: 1617;
  Gene Symbol: ABCB8;
  Gene Name: ATP-binding cassette, sub-family B (MDR/TAP), member 8;
  ENSP ID: ENSP00000418970
MLVHLFRVGIRGGPFPGRLLPPLRFQTFSAVSDTPVASRRLLRLQPRVSQKEGTLGVL

SEQ ID NO: 7673 - protein, 39 aa, Homo sapiens
  Payload ID: 1617;
  Gene Symbol: ABCB8;
  Gene Name: ATP-binding cassette, sub-family B (MDR/TAP), member 8;
  ENSP ID: ENSP00000419014
MLVHLFRVGIRGGPFPGRLLPPLRFQTFSAVSWPWVRHS

SEQ ID NO: 7674 - protein, 431 aa, Homo sapiens
  Payload ID: 1617;
  Gene Symbol: ABCB8;
  Gene Name: ATP-binding cassette, sub-family B (MDR/TAP), member 8;
  ENSP ID: ENSP00000419558
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQSFLRVAPCPNSLPLQAVTFHAWKDHP

SEQ ID NO: 7675 - protein, 409 aa, Homo sapiens
  Payload ID: 1617;
  Gene Symbol: ABCB8;
  Gene Name: ATP-binding cassette, sub-family B (MDR/TAP), member 8;
  ENSP ID: ENSP00000419891
MLVHLFRVGIRGGPFPGRLLPPLRFQTFSAVRYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRDVL

SEQ ID NO: 7676 - protein, 140 aa, Homo sapiens
  Payload ID: 1617;
  Gene Symbol: ABCB8;
  Gene Name: ATP-binding cassette, sub-family B (MDR/TAP), member 8;
  ENSP ID: ENSP00000420162
  MOD_RES (1)..(1): Any amino acid
XSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRL

SEQ ID NO: 7677 - protein, 48 aa, Homo sapiens; identical to SEQ ID NO: 7671
  Payload ID: 1617;
  Gene Symbol: ABCB8;
  Gene Name: ATP-binding cassette, sub-family B (MDR/TAP), member 8;
  ENSP ID: ENSP00000420216

SEQ ID NO: 7678 - protein, 39 aa, Homo sapiens; identical to SEQ ID NO: 7673
  Payload ID: 1617;
  Gene Symbol: ABCB8;
  Gene Name: ATP-binding cassette, sub-family B (MDR/TAP), member 8;
  ENSP ID: ENSP00000420631

SEQ ID NO: 7679 - protein, 630 aa, Homo sapiens
  Payload ID: 1617;
  Gene Symbol: ABCB8;
  Gene Name: ATP-binding cassette, sub-family B (MDR/TAP), member 8;
  Uniprot ID:  Q9NUT2;
  ENSP ID: ENSP00000438776
MRVKLLLPAAPVLPRQHAGAFISGRDSGWPIPRQAATAPPLPDILSCQLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 7680 - protein, 723 aa, Homo sapiens
  Payload ID: 1618;
  Gene Symbol: ABCB9;
  Gene Name: ATP-binding cassette, sub-family B (MDR/TAP), member 9;
  Uniprot ID:  Q9NP78;
  ENSP ID: ENSP00000280559
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGSVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 7681 - protein, 766 aa, Homo sapiens
  Payload ID: 1618;
  Gene Symbol: ABCB9;
  Gene Name: ATP-binding cassette, sub-family B (MDR/TAP), member 9;
  Uniprot ID:  Q9NP78;
  ENSP ID: ENSP00000280560
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 7682 - protein, 766 aa, Homo sapiens; identical to SEQ ID NO: 7681
  Payload ID: 1618;
  Gene Symbol: ABCB9;
  Gene Name: ATP-binding cassette, sub-family B (MDR/TAP), member 9;
  Uniprot ID:  Q9NP78;
  ENSP ID: ENSP00000376234

SEQ ID NO: 7683 - protein, 769 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000394898
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLSPQIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 7684 - protein, 145 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000415967
GRPPRLRASLGAAGHRPSRRLGPRCRSCSPTPSPTWPSSWPPPSSSSWQLWERPSCPTTRAAPLMASSSRKAWISSARLSSSCACWPLAGIRGGIFTLIFARLNIRLRNCLFRSLVSQETSFFDENRTASHGSSPWSPSWASPSS

SEQ ID NO: 7685 - protein, 272 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000439871
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGRYSGRHFYPHICQTEHSPSKLSLPLTGVPGDKLL

SEQ ID NO: 7686 - protein, 145 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000440138
MDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASN

SEQ ID NO: 7687 - protein, 260 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000440244
MKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYST

SEQ ID NO: 7688 - protein, 766 aa, Homo sapiens; identical to SEQ ID NO: 7681
  Payload ID: 1618;
  Gene Symbol: ABCB9;
  Gene Name: ATP-binding cassette, sub-family B (MDR/TAP), member 9;
  Uniprot ID:  Q9NP78;
  ENSP ID: ENSP00000440288

SEQ ID NO: 7689 - protein, 182 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000441086
MVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAA

SEQ ID NO: 7690 - protein, 703 aa, Homo sapiens
  Payload ID: 1618;
  Gene Symbol: ABCB9;
  Gene Name: ATP-binding cassette, sub-family B (MDR/TAP), member 9;
  Uniprot ID:  Q9NP78;
  ENSP ID: ENSP00000441734
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMENVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 7691 - protein, 277 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000442281
MGQGMGMVGDLRSPRPTSPLPLPQLTLLVVQVSILYYGGHLVISGQMTSGNLIAFIIYEFVLGDCMENVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGL

SEQ ID NO: 7692 - protein, 115 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000443224
MTASRWCRRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDC

SEQ ID NO: 7693 - protein, 65 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000443382
MRLWKAVVVTLAFMSVDICVTTAIYVFSHLDRSLLEDIRHFNIFDSVLDLWAACLYRSCLLLGAT

SEQ ID NO: 7694 - protein, 222 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000443433
MDQFSTAVVIVCLLAIGRLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCME

SEQ ID NO: 7695 - protein, 156 aa, Homo sapiens
  Payload ID: 1618;
  Gene Symbol: ABCB9;
  Gene Name: ATP-binding cassette, sub-family B (MDR/TAP), member 9;
  ENSP ID: ENSP00000444834
MGQGMGMVGDLRSPRPTSPLPLPQLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCV

SEQ ID NO: 7696 - protein, 683 aa, Homo sapiens
  Payload ID: 1618;
  Gene Symbol: ABCB9;
  Gene Name: ATP-binding cassette, sub-family B (MDR/TAP), member 9;
  Uniprot ID:  Q9NP78;
  ENSP ID: ENSP00000456375
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLCAG

SEQ ID NO: 7697 - protein, 681 aa, Homo sapiens
  Payload ID: 1618;
  Gene Symbol: ABCB9;
  Gene Name: ATP-binding cassette, sub-family B (MDR/TAP), member 9;
  Uniprot ID:  Q9NP78;
  ENSP ID: ENSP00000456813
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLI

SEQ ID NO: 7698 - protein, 1215 aa, Homo sapiens
  Payload ID: 1619;
  Gene Symbol: ABCC1;
  Gene Name: ATP-binding cassette, sub-family C (CFTR/MRP), member 1;
  ENSP ID: ENSP00000382340
MSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGSTVMDEEEAGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 7699 - protein, 1531 aa, Homo sapiens
  Payload ID: 1619;
  Gene Symbol: ABCC1;
  Gene Name: ATP-binding cassette, sub-family C (CFTR/MRP), member 1;
  Uniprot ID:  P33527;
  ENSP ID: ENSP00000382342
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 7700 - protein, 22 aa, Homo sapiens
  Payload ID: 1619;
  Gene Symbol: ABCC1;
  Gene Name: ATP-binding cassette, sub-family C (CFTR/MRP), member 1;
  ENSP ID: ENSP00000459693
LVTDSAGKQLQRFEGHFHLTRP

SEQ ID NO: 7701 - protein, 1440 aa, Homo sapiens
  Payload ID: 1619;
  Gene Symbol: ABCC1;
  Gene Name: ATP-binding cassette, sub-family C (CFTR/MRP), member 1;
  ENSP ID: ENSP00000461615
  MOD_RES (1)..(1): Any amino acid
XAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGSTVMDEEEAGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 7702 - protein, 1215 aa, Homo sapiens; identical to SEQ ID NO: 7698
  Payload ID: 1619;
  Gene Symbol: ABCC1;
  Gene Name: ATP-binding cassette, sub-family C (CFTR/MRP), member 1;
  ENSP ID: ENSP00000478647

SEQ ID NO: 7703 - protein, 1440 aa, Homo sapiens; identical to SEQ ID NO: 7701
  Payload ID: 1619;
  Gene Symbol: ABCC1;
  Gene Name: ATP-binding cassette, sub-family C (CFTR/MRP), member 1;
  ENSP ID: ENSP00000481080
  MOD_RES (1)..(1): Any amino acid

SEQ ID NO: 7704 - protein, 1531 aa, Homo sapiens; identical to SEQ ID NO: 7699
  Payload ID: 1619;
  Gene Symbol: ABCC1;
  Gene Name: ATP-binding cassette, sub-family C (CFTR/MRP), member 1;
  Uniprot ID:  P33527;
  ENSP ID: ENSP00000483316

SEQ ID NO: 7705 - protein, 1464 aa, Homo sapiens
  Payload ID: 1620;
  Gene Symbol: ABCC10;
  Gene Name: ATP-binding cassette, sub-family C (CFTR/MRP), member 10;
  Uniprot ID:  Q5T3U5;
  ENSP ID: ENSP00000244533
MCLLVFPLVPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDCGRLGAQIKWLLCSDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGGVEFQDVVLAYRPGLPNALDGVTFCVQPGEKLGIVGRTGSGKSSLLLVLFRLLEPSSGRVLLDGVDTSQLELAQLRSQLAIIPQEPFLFSGTVRENLDPQGLHKDRALWQALKQCHLSEVITSMGGLDGELGEGGRSLSLGQRQLLCLARALLTDAKILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 7706 - protein, 277 aa, Homo sapiens
  Payload ID: 1620;
  Gene Symbol: ABCC10;
  Gene Name: ATP-binding cassette, sub-family C (CFTR/MRP), member 10;
  ENSP ID: ENSP00000361593
MASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGE

SEQ ID NO: 7707 - protein, 1492 aa, Homo sapiens
  Payload ID: 1620;
  Gene Symbol: ABCC10;
  Gene Name: ATP-binding cassette, sub-family C (CFTR/MRP), member 10;
  Uniprot ID:  Q5T3U5;
  ENSP ID: ENSP00000361608
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGGVEFQDVVLAYRPGLPNALDGVTFCVQPGEKLGIVGRTGSGKSSLLLVLFRLLEPSSGRVLLDGVDTSQLELAQLRSQLAIIPQEPFLFSGTVRENLDPQGLHKDRALWQALKQCHLSEVITSMGGLDGELGEGGRSLSLGQRQLLCLARALLTDAKILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 7708 - protein, 129 aa, Homo sapiens
  Payload ID: 1620;
  Gene Symbol: ABCC10;
  Gene Name: ATP-binding cassette, sub-family C (CFTR/MRP), member 10;
  ENSP ID: ENSP00000422699
EEGIARKALYKLTAARADQGAEMEDRMSRQGQRTPSAQILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 7709 - protein, 1344 aa, Homo sapiens
  Payload ID: 1621;
  Gene Symbol: ABCC11;
  Gene Name: ATP-binding cassette, sub-family C (CFTR/MRP), member 11;
  Uniprot ID:  Q96J66;
  ENSP ID: ENSP00000311326
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAIILIDEATASIDMETDTLIQRTIREAFQGCTVLVIAHRVTTVLNCDHILVMGNGKVVEFDRPEVLRKKPGSLFAALMATATSSLR

SEQ ID NO: 7710 - protein, 1382 aa, Homo sapiens
  Payload ID: 1621;
  Gene Symbol: ABCC11;
  Gene Name: ATP-binding cassette, sub-family C (CFTR/MRP), member 11;
  Uniprot ID:  Q96J66;
  ENSP ID: ENSP00000349017
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 7711 - protein, 1382 aa, Homo sapiens; identical to SEQ ID NO: 7710
  Payload ID: 1621;
  Gene Symbol: ABCC11;
  Gene Name: ATP-binding cassette, sub-family C (CFTR/MRP), member 11;
  Uniprot ID:  Q96J66;
  ENSP ID: ENSP00000378230

SEQ ID NO: 7712 - protein, 1382 aa, Homo sapiens; identical to SEQ ID NO: 7710
  Payload ID: 1621;
  Gene Symbol: ABCC11;
  Gene Name: ATP-binding cassette, sub-family C (CFTR/MRP), member 11;
  Uniprot ID:  Q96J66;
  ENSP ID: ENSP00000378231

SEQ ID NO: 7713 - protein, 159 aa, Homo sapiens
  Payload ID: 1621;
  Gene Symbol: ABCC11;
  Gene Name: ATP-binding cassette, sub-family C (CFTR/MRP), member 11;
  ENSP ID: ENSP00000456268
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQ

SEQ ID NO: 7714 - protein, 1359 aa, Homo sapiens
  Payload ID: 1622;
  Gene Symbol: ABCC12;
  Gene Name: ATP-binding cassette, sub-family C (CFTR/MRP), member 12;
  Uniprot ID:  Q96J65;
  ENSP ID: ENSP00000311030
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPVILIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAGIIVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCITYHLLYFNCALRWFALRMDVLMNILTFTVALLVTLSFSSISTSSKGLSLSYIIQLSGLLQVCVRTGTETQAKFTSVELLREYISTCVPECTHPLKVGTCPKDWPSRGEITFRDYQMRYRDNTPLVLDSLNLNIQSGQTVGIVGRTGSGKSSLGMALFRLVEPASGTIFIDEVDICILSLEDLRTKLTVIPQDPVLFVGTVRYNLDPFESHTDEMLWQVLERTFMRDTIMKLPEKLQAEVTENGENFSVGERQLLCVARALLRNSKIILLDEATASMDSKTDTLVQNTIKDAFKGCTVLTIAHRLNTVLNCDHVLVMENGKVIEFDKPEVLAEKPDSAFAMLLAAEVRL

SEQ ID NO: 7715 - protein, 1009 aa, Homo sapiens
  Payload ID: 1622;
  Gene Symbol: ABCC12;
  Gene Name: ATP-binding cassette, sub-family C (CFTR/MRP), member 12;
  Uniprot ID:  Q96J65;
  ENSP ID: ENSP00000431232
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCIT

SEQ ID NO: 7716 - protein, 930 aa, Homo sapiens
  Payload ID: 1622;
  Gene Symbol: ABCC12;
  Gene Name: ATP-binding cassette, sub-family C (CFTR/MRP), member 12;
  Uniprot ID:  Q96J65;
  ENSP ID: ENSP00000431354
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAGIIVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCIT

SEQ ID NO: 7717 - protein, 935 aa, Homo sapiens
  Payload ID: 1622;
  Gene Symbol: ABCC12;
  Gene Name: ATP-binding cassette, sub-family C (CFTR/MRP), member 12;
  Uniprot ID:  Q96J65;
  ENSP ID: ENSP00000433333
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKHFPQRSPGAQEGGECQPVTLVHPHHLLHAGPGHHSRLWQEGELHHLV

SEQ ID NO: 7718 - protein, 633 aa, Homo sapiens
  Payload ID: 1622;
  Gene Symbol: ABCC12;
  Gene Name: ATP-binding cassette, sub-family C (CFTR/MRP), member 12;
  Uniprot ID:  Q96J65;
  ENSP ID: ENSP00000434510
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRLGSGASTSLGGRGRGLAWPALSTPTVSSTCWTTPCRPWTPTWGSTSLRSALRRRSGERQSSW

SEQ ID NO: 7719 - protein, 285 aa, Homo sapiens
  Payload ID: 1622;
  Gene Symbol: ABCC12;
  Gene Name: ATP-binding cassette, sub-family C (CFTR/MRP), member 12;
  ENSP ID: ENSP00000435715
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPTVLIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVCLWPSSIQLSEGQQFW

SEQ ID NO: 7720 - protein, 106 aa, Homo sapiens
  Payload ID: 1622;
  Gene Symbol: ABCC12;
  Gene Name: ATP-binding cassette, sub-family C (CFTR/MRP), member 12;
  ENSP ID: ENSP00000436647
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGP

SEQ ID NO: 7721 - protein, 1009 aa, Homo sapiens; identical to SEQ ID NO: 7715
  Payload ID: 1622;
  Gene Symbol: ABCC12;
  Gene Name: ATP-binding cassette, sub-family C (CFTR/MRP), member 12;
  Uniprot ID:  Q96J65;
  ENSP ID: ENSP00000437047

SEQ ID NO: 7722 - protein, 293 aa, Homo sapiens
  Payload ID: 1623;
  Gene Symbol: ABCC2;
  Gene Name: ATP-binding cassette, sub-family C (CFTR/MRP), member 2;
  ENSP ID: ENSP00000359463
MLEKFCNSTFWNSSFLDSPEADLPLCFEQTVLVWIPLGYLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLVTFP

SEQ ID NO: 7723 - protein, 1545 aa, Homo sapiens
  Payload ID: 1623;
  Gene Symbol: ABCC2;
  Gene Name: ATP-binding cassette, sub-family C (CFTR/MRP), member 2;
  Uniprot ID:  Q92887;
  ENSP ID: ENSP00000359478
MLEKFCNSTFWNSSFLDSPEADLPLCFEQTVLVWIPLGYLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 7724 - protein, 1527 aa, Homo sapiens
  Payload ID: 1624;
  Gene Symbol: ABCC3;
  Gene Name: ATP-binding cassette, sub-family C (CFTR/MRP), member 3;
  Uniprot ID:  O15438;
  ENSP ID: ENSP00000285238
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 7725 - protein, 572 aa, Homo sapiens
  Payload ID: 1624;
  Gene Symbol: ABCC3;
  Gene Name: ATP-binding cassette, sub-family C (CFTR/MRP), member 3;
  Uniprot ID:  O15438;
  ENSP ID: ENSP00000395160
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVRLGTGLGPCLQGSGCPGMARAHWTLP

SEQ ID NO: 7726 - protein, 300 aa, Homo sapiens
  Payload ID: 1624;
  Gene Symbol: ABCC3;
  Gene Name: ATP-binding cassette, sub-family C (CFTR/MRP), member 3;
  ENSP ID: ENSP00000421755
  MOD_RES (1)..(1): Any amino acid
XAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDERFYAATSRQLKRLESVSRSPIYSHFSETVTGASVIRAYNRSRDFEIISDTKVDANQRSCYPYIISNRWLS

SEQ ID NO: 7727 - protein, 56 aa, Homo sapiens
  Payload ID: 1624;
  Gene Symbol: ABCC3;
  Gene Name: ATP-binding cassette, sub-family C (CFTR/MRP), member 3;
  ENSP ID: ENSP00000422058
ALTCLGASGSGSVWLELFTVMPIFSCWMTHCPRWTLMWPSTSLTTSSGQKACWQAR

SEQ ID NO: 7728 - protein, 76 aa, Homo sapiens
  Payload ID: 1624;
  Gene Symbol: ABCC3;
  Gene Name: ATP-binding cassette, sub-family C (CFTR/MRP), member 3;
  ENSP ID: ENSP00000422786
MDALCGSGELGSKFWHWGARESEEECAAGAQRHSAWLGESAPSQPLRRVRKGRFAISRGFLMEGLPSASASGKTEV

SEQ ID NO: 7729 - protein, 43 aa, Homo sapiens
  Payload ID: 1624;
  Gene Symbol: ABCC3;
  Gene Name: ATP-binding cassette, sub-family C (CFTR/MRP), member 3;
  ENSP ID: ENSP00000424981
  MOD_RES (1)..(1): Any amino acid
XALILACFREKPPFFSAKNVDPNPYPETSAGFLSRLFFWWFTK

SEQ ID NO: 7730 - protein, 43 aa, Homo sapiens
  Payload ID: 1624;
  Gene Symbol: ABCC3;
  Gene Name: ATP-binding cassette, sub-family C (CFTR/MRP), member 3;
  ENSP ID: ENSP00000425697
MDALCGSGELGSKFWNPAHCLTHQGPHQTLSRPRVTLQGRGSL

SEQ ID NO: 7731 - protein, 510 aa, Homo sapiens
  Payload ID: 1624;
  Gene Symbol: ABCC3;
  Gene Name: ATP-binding cassette, sub-family C (CFTR/MRP), member 3;
  Uniprot ID:  O15438;
  ENSP ID: ENSP00000427073
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKLLNPDPLRGCLPGFTSPQDGHLWLPASPGGEGPLVPKGRGQIPDGGAAAAGGMEEAGKADGTTQGFSSTWEKCLRRGRGAAGCPAQAPEALLPEGPAGHLRLQLPHQCLLQAYPGPALLHQSTAAQHPDQVYLQPHGPLLVGLPGGWADVPVLHDAVADLTTLLPLHLCDWGEVSYWDHGCHLQEGSGYHQLSQTCVHCGGNCQPHVSGCPALHGPCPLPQSAVVSTPADHPGDLLPLAEPRSLCPGWSRFHGLADSTQRSCGREDARLPGKANEIEGLAHQADE

SEQ ID NO: 7732 - protein, 1238 aa, Homo sapiens
  Payload ID: 1624;
  Gene Symbol: ABCC3;
  Gene Name: ATP-binding cassette, sub-family C (CFTR/MRP), member 3;
  Uniprot ID:  O15438;
  ENSP ID: ENSP00000427521
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRSEAASLAPCSSRNSQQALWCSGSLSLLSPKQKTGPALPLPHFLLI

SEQ ID NO: 7733 - protein, 1325 aa, Homo sapiens
  Payload ID: 1625;
  Gene Symbol: ABCC4;
  Gene Name: ATP-binding cassette, sub-family C (CFTR/MRP), member 4;
  Uniprot ID:  O15439;
  ENSP ID: ENSP00000366084
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 7734 - protein, 784 aa, Homo sapiens
  Payload ID: 1625;
  Gene Symbol: ABCC4;
  Gene Name: ATP-binding cassette, sub-family C (CFTR/MRP), member 4;
  Uniprot ID:  O15439;
  ENSP ID: ENSP00000442024
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQRWDLAVLSWLVSNS

SEQ ID NO: 7735 - protein, 859 aa, Homo sapiens
  Payload ID: 1625;
  Gene Symbol: ABCC4;
  Gene Name: ATP-binding cassette, sub-family C (CFTR/MRP), member 4;
  Uniprot ID:  O15439;
  ENSP ID: ENSP00000487081
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQRWDLAVLSWLVSNS

SEQ ID NO: 7736 - protein, 1394 aa, Homo sapiens
  Payload ID: 1626;
  Gene Symbol: ABCC5;
  Gene Name: ATP-binding cassette, sub-family C (CFTR/MRP), member 5;
  Uniprot ID:  O15440;
  ENSP ID: ENSP00000265586
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGVYIQAAGGPLAFLVIMALFMLNVGSTAFSTWWLSYWIKQGSGNTTVTRGNETSVSDSMKDNPHMQYYASIYALSMAVMLILKAIRGVVFVKGTLRASSRLHDELFRRILRSPMKFFDTTPTGRILNRFSKDMDEVDVRLPFQAEMFIQNVILVFFCVGMIAGVFPWFLVAVGPLVILFSVLHIVSRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 7737 - protein, 1437 aa, Homo sapiens
  Payload ID: 1626;
  Gene Symbol: ABCC5;
  Gene Name: ATP-binding cassette, sub-family C (CFTR/MRP), member 5;
  Uniprot ID:  O15440;
  ENSP ID: ENSP00000333926
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGVYIQAAGGPLAFLVIMALFMLNVGSTAFSTWWLSYWIKQGSGNTTVTRGNETSVSDSMKDNPHMQYYASIYALSMAVMLILKAIRGVVFVKGTLRASSRLHDELFRRILRSPMKFFDTTPTGRILNRFSKDMDEVDVRLPFQAEMFIQNVILVFFCVGMIAGVFPWFLVAVGPLVILFSVLHIVSRVLIRELKRLDNITQSPFLSHITSSIQGLATIHAYNKGQEFLHRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 7738 - protein, 208 aa, Homo sapiens
  Payload ID: 1626;
  Gene Symbol: ABCC5;
  Gene Name: ATP-binding cassette, sub-family C (CFTR/MRP), member 5;
  Uniprot ID:  O15440;
  ENSP ID: ENSP00000371934
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPNFQDGCILRSE

SEQ ID NO: 7739 - protein, 225 aa, Homo sapiens
  Payload ID: 1626;
  Gene Symbol: ABCC5;
  Gene Name: ATP-binding cassette, sub-family C (CFTR/MRP), member 5;
  Uniprot ID:  O15440;
  ENSP ID: ENSP00000376358
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPPSFGDCSISAEVCGNRLHCTAILLSCFT

SEQ ID NO: 7740 - protein, 53 aa, Homo sapiens
  Payload ID: 1626;
  Gene Symbol: ABCC5;
  Gene Name: ATP-binding cassette, sub-family C (CFTR/MRP), member 5;
  ENSP ID: ENSP00000390911
MKDIDIGKEYIIPSPGYRSVRERTSTSGTHRDREDSKFRRTRPSQSLTLSPRL

SEQ ID NO: 7741 - protein, 147 aa, Homo sapiens
  Payload ID: 1626;
  Gene Symbol: ABCC5;
  Gene Name: ATP-binding cassette, sub-family C (CFTR/MRP), member 5;
  ENSP ID: ENSP00000399726
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCR

SEQ ID NO: 7742 - protein, 473 aa, Homo sapiens
  Payload ID: 1626;
  Gene Symbol: ABCC5;
  Gene Name: ATP-binding cassette, sub-family C (CFTR/MRP), member 5;
  ENSP ID: ENSP00000403510
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKLPSTV

SEQ ID NO: 7743 - protein, 70 aa, Homo sapiens
  Payload ID: 1626;
  Gene Symbol: ABCC5;
  Gene Name: ATP-binding cassette, sub-family C (CFTR/MRP), member 5;
  ENSP ID: ENSP00000404302
  MOD_RES (1)..(1): Any amino acid
XFTIKPKEKIGIVGRTGSEHWGTQPSTKEEQHPQLCYPERSTGNILGSPRWGWPSSVWWSYLEAASRLME

SEQ ID NO: 7744 - protein, 231 aa, Homo sapiens
  Payload ID: 1626;
  Gene Symbol: ABCC5;
  Gene Name: ATP-binding cassette, sub-family C (CFTR/MRP), member 5;
  ENSP ID: ENSP00000404809
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPVSSNHPFRQSPGARPRPALTLLFCCRGCAQLWAR

SEQ ID NO: 7745 - protein, 53 aa, Homo sapiens
  Payload ID: 1626;
  Gene Symbol: ABCC5;
  Gene Name: ATP-binding cassette, sub-family C (CFTR/MRP), member 5;
  ENSP ID: ENSP00000409913
MKDIDIGKEYIIPSPGYRSVRERTSTSGTHRDREDSKFRRTRPRHSHCWPGCC

SEQ ID NO: 7746 - protein, 212 aa, Homo sapiens
  Payload ID: 1626;
  Gene Symbol: ABCC5;
  Gene Name: ATP-binding cassette, sub-family C (CFTR/MRP), member 5;
  Uniprot ID:  O15440;
  ENSP ID: ENSP00000416840
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPLAWCCQDLDLGGVSL

SEQ ID NO: 7747 - protein, 1503 aa, Homo sapiens
  Payload ID: 1627;
  Gene Symbol: ABCC6;
  Gene Name: ATP-binding cassette, sub-family C (CFTR/MRP), member 6;
  Uniprot ID:  O95255;
  ENSP ID: ENSP00000205557
MAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTTRILVTHALHILPQADWIIVLANGAIAEMGSYQELLQRKGALMCLLDQARQPGDRGEGETEPGTSTKDPRGTSAGRRPELRRERSIKSVPEKDRTTSEAQTEVPLDDPDRAGWPAGKDSIQYGRVKATVHLAYLRAVGTPLCLYALFLFLCQQVASFCRGYWLSLWADDPAVGGQQTQAALRGGIFGLLGCLQAIGLFASMAAVLLGGARASRLLFQRLLWDVVRSPISFFERTPIGHLLNRFSKETDTVDVDIPDKLRSLLMYAFGLLEVSLVVAVATPLATVAILPLFLLYAGFQSLYVVSSCQLRRLESASYSSVCSHMAETFQGSTVVRAFRTQAPFVAQNNARVDESQRISFPRLVADRWLAANVELLGNGLVFAAATCAVLSKAHLSAGLVGFSVSAALQVTQTLQWVVRNWTDLENSIVSVERMQDYAWTPKEAPWRLPTCAAQPPWPQGGQIEFRDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 7748 - protein, 871 aa, Homo sapiens
  Payload ID: 1627;
  Gene Symbol: ABCC6;
  Gene Name: ATP-binding cassette, sub-family C (CFTR/MRP), member 6;
  Uniprot ID:  O95255;
  ENSP ID: ENSP00000405002
MAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTKQNLGPAPRTPEAPLQAGGPSLDARGPSSQSLRRTVPLQKPRQRFLWMTLTGQDGQQERTASNTAG

SEQ ID NO: 7749 - protein, 82 aa, Homo sapiens
  Payload ID: 1627;
  Gene Symbol: ABCC6;
  Gene Name: ATP-binding cassette, sub-family C (CFTR/MRP), member 6;
  ENSP ID: ENSP00000459243
MAAPAEPCAGQGVWNQTEPEPAATSLLSLCFLRTAGVWVPPMYLWVLGPIYLLFIHHHGRGYLRMSPLFKAKMRNQNILERP

SEQ ID NO: 7750 - protein, 99 aa, Homo sapiens
  Payload ID: 1627;
  Gene Symbol: ABCC6;
  Gene Name: ATP-binding cassette, sub-family C (CFTR/MRP), member 6;
  Uniprot ID:  O95255;
  ENSP ID: ENSP00000461686
MAAPAEPCAGQGVWNQTEPEPAATSLLSLCFLRTAGVWVPPMYLWVLGPIYLLFIHHHGRGYLRMSPLFKAKMVAAIPGSLEPGNVRGRQGTGWNLVKS

SEQ ID NO: 7751 - protein, 1503 aa, Homo sapiens
  Payload ID: 1627;
  Gene Symbol: ABCC6;
  Gene Name: ATP-binding cassette, sub-family C (CFTR/MRP), member 6;
  ENSP ID: ENSP00000479163
MAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGAVDSSSSGSAAGKDCITIQSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTTRILVTHALHILPQADWIIVLANGAIAEMGSYQELLQRKGALVCLLDQARQPGDRGEGETEPGTSTKDPRGTSAGRRPELRRERSIKSVPEKDRTTSEAQTEVPLDDPDRAGWPAGKDSIQYGRVKATVHLAYLRAVGTPLCLYALFLFLCQQVASFCRGYWLSLWADDPAVGGQQTQAALRGGIFGLLGCLQAIGLFASMAAVLLGGARASRLLFQRLLWDVVRSPISFFERTPIGHLLNRFSKETDTVDVDIPDKLRSLLMYAFGLLEVSLVVAVATPLATVAILPLFLLYAGFQSLYVVSSCQLRRLESASYSSVCSHMAETFQGSTVVRAFRTQAPFVAQNNARVDESQRISFPRLVADRWLAANVELLGNGLVFAAATCAVLSKAHLSAGLVGFSVSAALQVTQTLQWVVRNWTDLENSIVSVERMQDYAWTPKEAPWRLPTCAAQPPWPQGGQIEFQDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 7752 - protein, 99 aa, Homo sapiens; identical to SEQ ID NO: 7750
  Payload ID: 1627;
  Gene Symbol: ABCC6;
  Gene Name: ATP-binding cassette, sub-family C (CFTR/MRP), member 6;
  Uniprot ID:  O95255;
  ENSP ID: ENSP00000481979

SEQ ID NO: 7753 - protein, 871 aa, Homo sapiens; identical to SEQ ID NO: 7748
  Payload ID: 1627;
  Gene Symbol: ABCC6;
  Gene Name: ATP-binding cassette, sub-family C (CFTR/MRP), member 6;
  Uniprot ID:  O95255;
  ENSP ID: ENSP00000483331

SEQ ID NO: 7754 - protein, 871 aa, Homo sapiens
  Payload ID: 1627;
  Gene Symbol: ABCC6;
  Gene Name: ATP-binding cassette, sub-family C (CFTR/MRP), member 6;
  ENSP ID: ENSP00000487705
MAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGAVDSSSSGSAAGKDCITIQSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTKQNLGPAPRTPEAPLQAGGPSLDARGPSSQSLRRTVPLQKPRQRFLWMTLTGQDGQQERTASNTAG

SEQ ID NO: 7755 - protein, 82 aa, Homo sapiens; identical to SEQ ID NO: 7749
  Payload ID: 1627;
  Gene Symbol: ABCC6;
  Gene Name: ATP-binding cassette, sub-family C (CFTR/MRP), member 6;
  ENSP ID: ENSP00000488537

SEQ ID NO: 7756 - protein, 1582 aa, Homo sapiens
  Payload ID: 1628;
  Gene Symbol: ABCC8;
  Gene Name: ATP-binding cassette, sub-family C (CFTR/MRP), member 8;
  Uniprot ID:  Q09428;
  ENSP ID: ENSP00000303960
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 7757 - protein, 1581 aa, Homo sapiens
  Payload ID: 1628;
  Gene Symbol: ABCC8;
  Gene Name: ATP-binding cassette, sub-family C (CFTR/MRP), member 8;
  Uniprot ID:  Q09428;
  ENSP ID: ENSP00000374467
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 7758 - protein, 997 aa, Homo sapiens
  Payload ID: 1628;
  Gene Symbol: ABCC8;
  Gene Name: ATP-binding cassette, sub-family C (CFTR/MRP), member 8;
  ENSP ID: ENSP00000431653
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKRRQLRARRMTTCRPCCTSVLRSHGEPAPSTCPPPASCSCRCWSSHSCSSTWSWWPSTTGWPSGPTAP

SEQ ID NO: 7759 - protein, 204 aa, Homo sapiens
  Payload ID: 1628;
  Gene Symbol: ABCC8;
  Gene Name: ATP-binding cassette, sub-family C (CFTR/MRP), member 8;
  ENSP ID: ENSP00000433638
  MOD_RES (1)..(1): Any amino acid
XQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLARPPAPSLIPKNWPDQGKIQIQNLSVRYDSSLKPVLKHVNALIAPGQKIGI

SEQ ID NO: 7760 - protein, 53 aa, Homo sapiens
  Payload ID: 1628;
  Gene Symbol: ABCC8;
  Gene Name: ATP-binding cassette, sub-family C (CFTR/MRP), member 8;
  ENSP ID: ENSP00000434893
  MOD_RES (1)..(1): Any amino acid
XPSGPSGMRPGSSRSFSNTQTPTTLLPSSSQLPTDGWKSEWSTSVHVWCSSQR

SEQ ID NO: 7761 - protein, 62 aa, Homo sapiens
  Payload ID: 1628;
  Gene Symbol: ABCC8;
  Gene Name: ATP-binding cassette, sub-family C (CFTR/MRP), member 8;
  ENSP ID: ENSP00000435378
  MOD_RES (1)..(1): Any amino acid
XLPSSAWWTRSKGTSSLMALTSPNCRCTPCAHASPSSCRTPSSSAAPSGPGSLWKGIPHPWV

SEQ ID NO: 7762 - protein, 33 aa, Homo sapiens
  Payload ID: 1628;
  Gene Symbol: ABCC8;
  Gene Name: ATP-binding cassette, sub-family C (CFTR/MRP), member 8;
  ENSP ID: ENSP00000437233
  MOD_RES (1)..(1): Any amino acid
XRTGSGKSSFSLAFFRMVDTFEGPRPLQRHHPI

SEQ ID NO: 7763 - protein, 50 aa, Homo sapiens
  Payload ID: 1628;
  Gene Symbol: ABCC8;
  Gene Name: ATP-binding cassette, sub-family C (CFTR/MRP), member 8;
  Uniprot ID:  Q09428;
  ENSP ID: ENSP00000483031
MPLAFCGSENHSAAYRVDQGVLNNGCFVDALNVVPHVFLLFITFPILFIG

SEQ ID NO: 7764 - protein, 1549 aa, Homo sapiens
  Payload ID: 1629;
  Gene Symbol: ABCC9;
  Gene Name: ATP-binding cassette, sub-family C (CFTR/MRP), member 9;
  Uniprot ID:  O60706;
  ENSP ID: ENSP00000261200
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVHTILTADLVIVMKRGNILEYDTPESLLAQENGVFASFVRADM

SEQ ID NO: 7765 - protein, 1549 aa, Homo sapiens
  Payload ID: 1629;
  Gene Symbol: ABCC9;
  Gene Name: ATP-binding cassette, sub-family C (CFTR/MRP), member 9;
  Uniprot ID:  O60706;
  ENSP ID: ENSP00000261201
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVSSIMDAGLVLVFSEGILVECDTVPNLLAHKNGLFSTLVMTNK

SEQ ID NO: 7766 - protein, 149 aa, Homo sapiens
  Payload ID: 1629;
  Gene Symbol: ABCC9;
  Gene Name: ATP-binding cassette, sub-family C (CFTR/MRP), member 9;
  ENSP ID: ENSP00000317518
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLGFSHHESKSCYQHS

SEQ ID NO: 7767 - protein, 1176 aa, Homo sapiens
  Payload ID: 1629;
  Gene Symbol: ABCC9;
  Gene Name: ATP-binding cassette, sub-family C (CFTR/MRP), member 9;
  ENSP ID: ENSP00000440521
ISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVSSIMDAGLVLVFSEGILVECDTVPNLLAHKNGLFSTLVMTNK

SEQ ID NO: 7768 - protein, 170 aa, Homo sapiens
  Payload ID: 1629;
  Gene Symbol: ABCC9;
  Gene Name: ATP-binding cassette, sub-family C (CFTR/MRP), member 9;
  ENSP ID: ENSP00000442604
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLVPGVSVSGLESKDIFPRFKPFTDAVGMPHFTRITM

SEQ ID NO: 7769 - protein, 149 aa, Homo sapiens; identical to SEQ ID NO: 7766
  Payload ID: 1629;
  Gene Symbol: ABCC9;
  Gene Name: ATP-binding cassette, sub-family C (CFTR/MRP), member 9;
  ENSP ID: ENSP00000480233

SEQ ID NO: 7770 - protein, 745 aa, Homo sapiens [sequence omitted]

SEQ ID NO: 7771 - protein, 227 aa, Homo sapiens
  Payload ID: 1630;
  Gene Symbol: ABCD1;
  Gene Name: ATP-binding cassette, sub-family D (ALD), member 1;
  ENSP ID: ENSP00000359147
MDGRLRNPDQSLTEDVVAFAASVAHLYSNLTKPLLDVAVTSYTLLRAARSRGAGTAWPSAIAGLVVFLTANVLRAFSPKFGELVAEEARRKGELRYMHSRVVANSEEIAFYGGHEVELALLQRSYQDLASQINLILLERLWYVMLEQFLMKYVWSASGLLMVAVPIITATGYSESGETQGSKRIQARGLSPIPLGAELTRAQLSQPAAHFCCRGHRGPAASLDAFRG

SEQ ID NO: 7772 - protein, 740 aa, Homo sapiens
  Payload ID: 1631;
  Gene Symbol: ABCD2;
  Gene Name: ATP-binding cassette, sub-family D (ALD), member 2;
  Uniprot ID:  Q9UBJ2;
  ENSP ID: ENSP00000310688
MTHMLNAAADRVKWTRSSAAKRAACLVAAAYALKTLYPIIGKRLKQSGHGKKKAAAYPAAENTEILHCTETICEKPSPGVNADFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFTNQTYYKVINMDGRLANPDQSLTEDIMMFSQSVAHLYSNLTKPILDVMLTSYTLIQTATSRGASPIGPTLLAGLVVYATAKVLKACSPKFGKLVAEEAHRKGYLRYVHSRIIANVEEIAFYRGHKVEMKQLQKSYKALADQMNLILSKRLWYIMIEQFLMKYVWSSSGLIMVAIPIITATGFADGEDGQKQVMVSERTEAFTTARNLLASGADAIERIMSSYKEVTELAGYTARVYNMFWVFDEVKRGIYKRTAVIQESESHSKNGAKVELPLSDTLAIKGKVIDVDHGIICENVPIITPAGEVVASRLNFKVEEGMHLLITGPNGCGKSSLFRILSGLWPVYEGVLYKPPPQHMFYIPQRPYMSLGSLRDQVIYPDSVDDMHDKGYTDQDLERILHNVHLYHIVQREGGWDAVMDWKDVLSGGEKQRMGMARMFYHKPKYALLDECTSAVSIDVEGKIFQAAKGAGISLLSITHRPSLWKYHTHLLQFDGEGGWRFEQLDTAIRLTLSEEKQKLESQLAGIPKMQQRLNELCKILGEDSVLKTIKNEDETS

SEQ ID NO: 7773 - protein, 236 aa, Homo sapiens
  Payload ID: 1632;
  Gene Symbol: ABCD3;
  Gene Name: ATP-binding cassette, sub-family D (ALD), member 3;
  Uniprot ID:  P28288;
  ENSP ID: ENSP00000326880
MAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQVLGKILWH

SEQ ID NO: 7774 - protein, 659 aa, Homo sapiens
  Payload ID: 1632;
  Gene Symbol: ABCD3;
  Gene Name: ATP-binding cassette, sub-family D (ALD), member 3;
  Uniprot ID:  P28288;
  ENSP ID: ENSP00000359233
MAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 7775 - protein, 606 aa, Homo sapiens
  Payload ID: 1633;
  Gene Symbol: ABCD4;
  Gene Name: ATP-binding cassette, sub-family D (ALD), member 4;
  Uniprot ID:  O14678;
  ENSP ID: ENSP00000349396
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 7776 - protein, 173 aa, Homo sapiens
  Payload ID: 1633;
  Gene Symbol: ABCD4;
  Gene Name: ATP-binding cassette, sub-family D (ALD), member 4;
  ENSP ID: ENSP00000432557
  MOD_RES (1)..(1): Any amino acid
XVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGDISPEGGLPRLRFCR

SEQ ID NO: 7777 - protein, 56 aa, Homo sapiens
  Payload ID: 1633;
  Gene Symbol: ABCD4;
  Gene Name: ATP-binding cassette, sub-family D (ALD), member 4;
  ENSP ID: ENSP00000432630
MAVAGPAPGAGARPRLDLQFLQRFLQILKVLFPSWSSQNALMFLTLLCLTLLAEEL

SEQ ID NO: 7778 - protein, 39 aa, Homo sapiens
  Payload ID: 1633;
  Gene Symbol: ABCD4;
  Gene Name: ATP-binding cassette, sub-family D (ALD), member 4;
  ENSP ID: ENSP00000434626
MAVAGPAPGAGARAICDLPGWLDPQSVLWGPGKQRLGRV

SEQ ID NO: 7779 - protein, 184 aa, Homo sapiens
  Payload ID: 1633;
  Gene Symbol: ABCD4;
  Gene Name: ATP-binding cassette, sub-family D (ALD), member 4;
  ENSP ID: ENSP00000434792
  MOD_RES (1)..(1): Any amino acid
XERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLVSGERDPQDPSPPGSTSYSPTWWQGQRAWTSRWTGTGMMFCPRGRCNGSPLPDSSTCSRSTQCLMKPPVP

SEQ ID NO: 7780 - protein, 56 aa, Homo sapiens; identical to SEQ ID NO: 7777
  Payload ID: 1633;
  Gene Symbol: ABCD4;
  Gene Name: ATP-binding cassette, sub-family D (ALD), member 4;
  ENSP ID: ENSP00000436527

SEQ ID NO: 7781 - protein, 56 aa, Homo sapiens; identical to SEQ ID NO: 7777
  Payload ID: 1633;
  Gene Symbol: ABCD4;
  Gene Name: ATP-binding cassette, sub-family D (ALD), member 4;
  ENSP ID: ENSP00000436782

SEQ ID NO: 7782 - protein, 39 aa, Homo sapiens; identical to SEQ ID NO: 7778
  Payload ID: 1633;
  Gene Symbol: ABCD4;
  Gene Name: ATP-binding cassette, sub-family D (ALD), member 4;
  ENSP ID: ENSP00000450491

SEQ ID NO: 7783 - protein, 56 aa, Homo sapiens; identical to SEQ ID NO: 7777
  Payload ID: 1633;
  Gene Symbol: ABCD4;
  Gene Name: ATP-binding cassette, sub-family D (ALD), member 4;
  ENSP ID: ENSP00000450611

SEQ ID NO: 7784 - protein, 184 aa, Homo sapiens; identical to SEQ ID NO: 7779
  Payload ID: 1633;
  Gene Symbol: ABCD4;
  Gene Name: ATP-binding cassette, sub-family D (ALD), member 4;
  ENSP ID: ENSP00000450960
  MOD_RES (1)..(1): Any amino acid

SEQ ID NO: 7785 - protein, 158 aa, Homo sapiens
  Payload ID: 1633;
  Gene Symbol: ABCD4;
  Gene Name: ATP-binding cassette, sub-family D (ALD), member 4;
  ENSP ID: ENSP00000450982
  MOD_RES (1)..(1): Any amino acid
XGSADDERILRFLELAGLSNLVARTEGLDQQVDWNWYDVLSPGEMQRLSFARLFYLQPKYAVLDEATSALTEEVESELYRIGQQLGMTFISVGHRQSLEKGSLISMWWWSLVVSFLGSETLWRRKMGADENQSGMKLWLLEGEPHCGGSAALRRDQED

SEQ ID NO: 7786 - protein, 98 aa, Homo sapiens
  Payload ID: 1633;
  Gene Symbol: ABCD4;
  Gene Name: ATP-binding cassette, sub-family D (ALD), member 4;
  ENSP ID: ENSP00000451457
MAVAGPAPGAGARPRLDLQFLQRFLQILKVLFPSWSSQNALMFLTLLCLTLLGTSASARTWSDSAGSSAAWPASSSSPRSPSSTTLTSASKAQAGSGL

SEQ ID NO: 7787 - protein, 39 aa, Homo sapiens; identical to SEQ ID NO: 7778
  Payload ID: 1633;
  Gene Symbol: ABCD4;
  Gene Name: ATP-binding cassette, sub-family D (ALD), member 4;
  ENSP ID: ENSP00000451521

SEQ ID NO: 7788 - protein, 205 aa, Homo sapiens
  Payload ID: 1633;
  Gene Symbol: ABCD4;
  Gene Name: ATP-binding cassette, sub-family D (ALD), member 4;
  ENSP ID: ENSP00000451770
  MOD_RES (1)..(1): Any amino acid
XRSRGPRPELAPEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYSRHQHL

SEQ ID NO: 7789 - protein, 39 aa, Homo sapiens; identical to SEQ ID NO: 7778
  Payload ID: 1633;
  Gene Symbol: ABCD4;
  Gene Name: ATP-binding cassette, sub-family D (ALD), member 4;
  ENSP ID: ENSP00000451778

SEQ ID NO: 7790 - protein, 203 aa, Homo sapiens
  Payload ID: 1633;
  Gene Symbol: ABCD4;
  Gene Name: ATP-binding cassette, sub-family D (ALD), member 4;
  ENSP ID: ENSP00000451993
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQRFKHMQIRVNAEPAAFYSRHQHL

SEQ ID NO: 7791 - protein, 94 aa, Homo sapiens
  Payload ID: 1633;
  Gene Symbol: ABCD4;
  Gene Name: ATP-binding cassette, sub-family D (ALD), member 4;
  ENSP ID: ENSP00000452430
  MOD_RES (1)..(1): Any amino acid
XILGTVVNKTLMGPIVMKLVHQEKLEGDFRFKHMQIRVNAEPAAFYSPVDIPAFPCQSWACGAHEDRPQAAETPSDPEGADVQGALAVHRHQHL

SEQ ID NO: 7792 - protein, 599 aa, Homo sapiens
  Payload ID: 1634;
  Gene Symbol: ABCE1;
  Gene Name: ATP-binding cassette, sub-family E (OABP), member 1;
  Uniprot ID:  P61221;
  ENSP ID: ENSP00000296577
MADKLTRIAIVNHDKCKPKKCRQECKKSCPVVRMGKLCIEVTPQSKIAWISETLCIGCGICIKKCPFGALSIVNLPSNLEKETTHRYCANAFKLHRLPIPRPGEVLGLVGTNGIGKSTALKILAGKQKPNLGKYDDPPDWQEILTYFRGSELQNYFTKILEDDLKAIIKPQYVDQIPKAAKGTVGSILDRKDETKTQAIVCQQLDLTHLKERNVEDLSGGELQRFACAVVCIQKADIFMFDEPSSYLDVKQRLKAAITIRSLINPDRYIIVVEHDLSVLDYLSDFICCLYGVPSAYGVVTMPFSVREGINIFLDGYVPTENLRFRDASLVFKVAETANEEEVKKMCMYKYPGMKKKMGEFELAIVAGEFTDSEIMVMLGENGTGKTTFIRMLAGRLKPDEGGEVPVLNVSYKPQKISPKSTGSVRQLLHEKIRDAYTHPQFVTDVMKPLQIENIIDQEVQTLSGGELQRVALALCLGKPADVYLIDEPSAYLDSEQRLMAARVVKRFILHAKKTAFVVEHDFIMATYLADRVIVFDGVPSKNTVANSPQTLLAGMNKFLSQLEITFRRDPNNYRPRINKLNSIKDVEQKKSGNYFFLDD

SEQ ID NO: 7793 - protein, 210 aa, Homo sapiens
  Payload ID: 1634;
  Gene Symbol: ABCE1;
  Gene Name: ATP-binding cassette, sub-family E (OABP), member 1;
  ENSP ID: ENSP00000421250
MADKLTRIAIVNHDKCKPKKCRQECKKSCPVVRMGKLCIEVTPQSKIAWISETLCIGCGICIKKCPFGALSIVNLPSNLEKETTHRYCANAFKLHRLPIPRPGEVLGLVGTNGIGKSTALKILAGKQKPNLGKYDDPPDWQEILTYFRGSELQNYFTKILEDDLKAIIKPQYVDQIPKAAKGTVGSILDRKDETKTQAIVCQQLDLTHLK

SEQ ID NO: 7794 - protein, 421 aa, Homo sapiens
  Payload ID: 1634;
  Gene Symbol: ABCE1;
  Gene Name: ATP-binding cassette, sub-family E (OABP), member 1;
  ENSP ID: ENSP00000422068
MADKLTRIAIVNHDKCKPKKCRQECKKSCPVVRMGKLCIEVTPQSKIAWISETLCIGCGICIKKCPFGALSIVNLPSNLEKETTHRYCANAFKLHRLPIPRPGEVLGLVGTNGIGKSTALKILAGKQKPNLGKYDDPPDWQEILTYFRGSELQNYFTKILEDDLKAIIKPQYVDQIPKAAKGTVGSILDRKDETKTQAIVCQQLDLTHLKERNVEDLSGGELQRFACAVVCIQKADIFMFDEPSSYLDVKQRLKAAITIRSLINPDRYIIVVEHDLSVLDYLSDFICCLYGVPSAYGVVTMPFSVREGINIFLDGYVPTENLRFRDASLVFKVAETANEEEVKKMCMYKYPGMKKKMGEFELAIVAGEFTDSEIMVMLGENGTGKTTFIRMLAGRLKPDEGGEVPVLNVSYKPQKISPKST

SEQ ID NO: 7795 - protein, 147 aa, Homo sapiens
  Payload ID: 1634;
  Gene Symbol: ABCE1;
  Gene Name: ATP-binding cassette, sub-family E (OABP), member 1;
  ENSP ID: ENSP00000423415
GALSIVNLPSNLEKETTHRYCANAFKLHRLPIPRPGEVLGLVGTNGIGKSTALKILAGKQKPNLGKYDDPPDWQEILTYFRGSELQNYFTKILEDDLKAIIKPQYVDQIPKAAKGTVGSILDRKDETKTQAIVCQQLVSCLMSLLVT

SEQ ID NO: 7796 - protein, 845 aa, Homo sapiens
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000313603
MPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 7797 - protein, 807 aa, Homo sapiens
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000365728
MPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 7798 - protein, 807 aa, Homo sapiens; identical to SEQ ID NO: 7797
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000373081

SEQ ID NO: 7799 - protein, 845 aa, Homo sapiens; identical to SEQ ID NO: 7796
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000373082

SEQ ID NO: 7800 - protein, 238 aa, Homo sapiens
  Payload ID: 1635;
  Gene Symbol: ABCF1;
  Gene Name: ATP-binding cassette, sub-family F (GCN20), member 1;
  ENSP ID: ENSP00000383452
MPKAPKQQPPEPEWIGDGESTSPSDKVVKKGKKDKKIKKTFFEELAVEDKQAGEEEKVLKEKEQQQQQQQQQQKKKRDTRKGRRKKDVDDDGEEKELMERLKKLSRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 7801 - protein, 845 aa, Homo sapiens; identical to SEQ ID NO: 7796
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000389065

SEQ ID NO: 7802 - protein, 807 aa, Homo sapiens; identical to SEQ ID NO: 7797
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000389472

SEQ ID NO: 7803 - protein, 238 aa, Homo sapiens; identical to SEQ ID NO: 7800
  Payload ID: 1635;
  Gene Symbol: ABCF1;
  Gene Name: ATP-binding cassette, sub-family F (GCN20), member 1;
  ENSP ID: ENSP00000390550

SEQ ID NO: 7804 - protein, 807 aa, Homo sapiens; identical to SEQ ID NO: 7797
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000391102

SEQ ID NO: 7805 - protein, 807 aa, Homo sapiens; identical to SEQ ID NO: 7797
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000393143

SEQ ID NO: 7806 - protein, 238 aa, Homo sapiens; identical to SEQ ID NO: 7800
  Payload ID: 1635;
  Gene Symbol: ABCF1;
  Gene Name: ATP-binding cassette, sub-family F (GCN20), member 1;
  ENSP ID: ENSP00000394785

SEQ ID NO: 7807 - protein, 339 aa, Homo sapiens
  Payload ID: 1635;
  Gene Symbol: ABCF1;
  Gene Name: ATP-binding cassette, sub-family F (GCN20), member 1;
  ENSP ID: ENSP00000394994
MPKAPKQQPPEPEWIGDGESTSPSDKVVKKGKKDKKIKKTFFEELAVEDKQAGEEEKVLKEKEQQQQQQQQQQQKKKRDTRKGRRKKDVDDDGEEKELMERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEEDKEEEIIKEKEPPKQGKEKAKKAEQGSEEEGEGEEEEEEGGESKADDPYAHLSKKEKKKLKKQMEYERQVASLKAANAAENDFSVSQAEMSSRQAMLENASDIKLEKFSISAHGKELFVNADLYIVAGRRYGLVGPN

SEQ ID NO: 7808 - protein, 238 aa, Homo sapiens; identical to SEQ ID NO: 7800
  Payload ID: 1635;
  Gene Symbol: ABCF1;
  Gene Name: ATP-binding cassette, sub-family F (GCN20), member 1;
  ENSP ID: ENSP00000395308

SEQ ID NO: 7809 - protein, 238 aa, Homo sapiens; identical to SEQ ID NO: 7800
  Payload ID: 1635;
  Gene Symbol: ABCF1;
  Gene Name: ATP-binding cassette, sub-family F (GCN20), member 1;
  ENSP ID: ENSP00000397199

SEQ ID NO: 7810 - protein, 238 aa, Homo sapiens; identical to SEQ ID NO: 7800
  Payload ID: 1635;
  Gene Symbol: ABCF1;
  Gene Name: ATP-binding cassette, sub-family F (GCN20), member 1;
  ENSP ID: ENSP00000397875

SEQ ID NO: 7811 - protein, 339 aa, Homo sapiens; identical to SEQ ID NO: 7807
  Payload ID: 1635;
  Gene Symbol: ABCF1;
  Gene Name: ATP-binding cassette, sub-family F (GCN20), member 1;
  ENSP ID: ENSP00000401969

SEQ ID NO: 7812 - protein, 807 aa, Homo sapiens; identical to SEQ ID NO: 7797
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000403526

SEQ ID NO: 7813 - protein, 807 aa, Homo sapiens; identical to SEQ ID NO: 7797
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000404726

SEQ ID NO: 7814 - protein, 339 aa, Homo sapiens; identical to SEQ ID NO: 7807
  Payload ID: 1635;
  Gene Symbol: ABCF1;
  Gene Name: ATP-binding cassette, sub-family F (GCN20), member 1;
  ENSP ID: ENSP00000405512

SEQ ID NO: 7815 - protein, 339 aa, Homo sapiens; identical to SEQ ID NO: 7807
  Payload ID: 1635;
  Gene Symbol: ABCF1;
  Gene Name: ATP-binding cassette, sub-family F (GCN20), member 1;
  ENSP ID: ENSP00000406756

SEQ ID NO: 7816 - protein, 339 aa, Homo sapiens; identical to SEQ ID NO: 7807
  Payload ID: 1635;
  Gene Symbol: ABCF1;
  Gene Name: ATP-binding cassette, sub-family F (GCN20), member 1;
  ENSP ID: ENSP00000406926

SEQ ID NO: 7817 - protein, 339 aa, Homo sapiens; identical to SEQ ID NO: 7807
  Payload ID: 1635;
  Gene Symbol: ABCF1;
  Gene Name: ATP-binding cassette, sub-family F (GCN20), member 1;
  ENSP ID: ENSP00000406948

SEQ ID NO: 7818 - protein, 845 aa, Homo sapiens; identical to SEQ ID NO: 7796
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000411327

SEQ ID NO: 7819 - protein, 845 aa, Homo sapiens; identical to SEQ ID NO: 7796
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000412553

SEQ ID NO: 7820 - protein, 845 aa, Homo sapiens; identical to SEQ ID NO: 7796
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000413319

SEQ ID NO: 7821 - protein, 845 aa, Homo sapiens; identical to SEQ ID NO: 7796
  Payload ID: 1635;
  Gene Symbol: ABCF1;
  Gene Name: ATP-binding cassette, sub-family F (GCN20), member 1;
  Uniprot ID:  Q8NE71;
  ENSP ID: ENSP00000414373

SEQ ID NO: 7822 - protein, 339 aa, Homo sapiens; identical to SEQ ID NO: 7807
  Payload ID: 1635;
  Gene Symbol: ABCF1;
  Gene Name: ATP-binding cassette, sub-family F (GCN20), member 1;
  ENSP ID: ENSP00000416890

SEQ ID NO: 7823 - protein, 105 aa, Homo sapiens
  Payload ID: 1635;
  Gene Symbol: ABCF1;
  Gene Name: ATP-binding cassette, sub-family F (GCN20), member 1;
  ENSP ID: ENSP00000440893
MERLKKLSVPTSDEEDEVPAPKPRGGKKTKGGNVFAALIQDQSEEEEEEEKHPPKPAKPEKNRINKAVSEEQQPALKGKKGKEEKSKGKAKPQNKFAALDNEEED

SEQ ID NO: 7824 - protein, 596 aa, Homo sapiens
  Payload ID: 1635;
  Gene Symbol: ABCF1;
  Gene Name: ATP-binding cassette, sub-family F (GCN20), member 1;
  ENSP ID: ENSP00000445100
  MOD_RES (1)..(1): Any amino acid
XAHLSKKEKKKLKKQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAAERLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYQGQKPLFKNLDFGIDMDSRICIVGPNGVGKSTLLLLLTGKLTPTHGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFEDYKREVLEALGEVMVSRPRE

SEQ ID NO: 7825 - protein, 634 aa, Homo sapiens
  Payload ID: 1636;
  Gene Symbol: ABCF2;
  Gene Name: ATP-binding cassette, sub-family F (GCN20), member 2;
  Uniprot ID:  Q9UG63;
  ENSP ID: ENSP00000222388
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNVCTLTLASLPRP

SEQ ID NO: 7826 - protein, 623 aa, Homo sapiens
  Payload ID: 1636;
  Gene Symbol: ABCF2;
  Gene Name: ATP-binding cassette, sub-family F (GCN20), member 2;
  Uniprot ID:  Q9UG63;
  ENSP ID: ENSP00000287844
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNV

SEQ ID NO: 7827 - protein, 240 aa, Homo sapiens
  Payload ID: 1636;
  Gene Symbol: ABCF2;
  Gene Name: ATP-binding cassette, sub-family F (GCN20), member 2;
  ENSP ID: ENSP00000395785
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALA

SEQ ID NO: 7828 - protein, 287 aa, Homo sapiens
  Payload ID: 1636;
  Gene Symbol: ABCF2;
  Gene Name: ATP-binding cassette, sub-family F (GCN20), member 2;
  ENSP ID: ENSP00000419720
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDF

SEQ ID NO: 7829 - protein, 703 aa, Homo sapiens
  Payload ID: 1637;
  Gene Symbol: ABCF3;
  Gene Name: ATP-binding cassette, sub-family F (GCN20), member 3;
  Uniprot ID:  Q9NUQ8;
  ENSP ID: ENSP00000292808
MATCAEILRSEFPEIDGQVFDYVTGVLHSGSADFESVDDLVEAVGELLQEVSGDSKDDAGIRAVCQRMAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 7830 - protein, 709 aa, Homo sapiens
  Payload ID: 1637;
  Gene Symbol: ABCF3;
  Gene Name: ATP-binding cassette, sub-family F (GCN20), member 3;
  Uniprot ID:  Q9NUQ8;
  ENSP ID: ENSP00000411471
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 7831 - protein, 103 aa, Homo sapiens
  Payload ID: 1637;
  Gene Symbol: ABCF3;
  Gene Name: ATP-binding cassette, sub-family F (GCN20), member 3;
  ENSP ID: ENSP00000415704
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYGRR

SEQ ID NO: 7832 - protein, 663 aa, Homo sapiens
  Payload ID: 1638;
  Gene Symbol: ABCG1;
  Gene Name: ATP-binding cassette, sub-family G (WHITE), member 1;
  Uniprot ID:  P45844;
  ENSP ID: ENSP00000291524
MIMRLPQPHGTNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 7833 - protein, 677 aa, Homo sapiens
  Payload ID: 1638;
  Gene Symbol: ABCG1;
  Gene Name: ATP-binding cassette, sub-family G (WHITE), member 1;
  Uniprot ID:  P45844;
  ENSP ID: ENSP00000339744
MRISLPRAPERDGGVSASSLLDTVTNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 7834 - protein, 678 aa, Homo sapiens
  Payload ID: 1638;
  Gene Symbol: ABCG1;
  Gene Name: ATP-binding cassette, sub-family G (WHITE), member 1;
  Uniprot ID:  P45844;
  ENSP ID: ENSP00000354995
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 7835 - protein, 824 aa, Homo sapiens
  Payload ID: 1638;
  Gene Symbol: ABCG1;
  Gene Name: ATP-binding cassette, sub-family G (WHITE), member 1;
  ENSP ID: ENSP00000381464
MLAVQQTEHLPACPPARRWSSNFCPESTEGGPSLLGLRDMVRRGWSVCTAILLARLWCLVPTHTFLSEYPEAAEYPHPGWVYWLQMAVAPGHLRAWVMRNNVTTNIPSAFSGTLTHEEKAVLTVFTGTATAVHVQVAALASAKLESSVFVTDCVSCKIENVCDSALQGKRVPMSGLQGSSIVIMPPSNRPLASAASCTWSVQVQGGPHHLGVVAISGKVLSAAHGAGRAYGWGFPGDPMEEGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 7836 - protein, 666 aa, Homo sapiens
  Payload ID: 1638;
  Gene Symbol: ABCG1;
  Gene Name: ATP-binding cassette, sub-family G (WHITE), member 1;
  Uniprot ID:  P45844;
  ENSP ID: ENSP00000381467
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 7837 - protein, 668 aa, Homo sapiens
  Payload ID: 1638;
  Gene Symbol: ABCG1;
  Gene Name: ATP-binding cassette, sub-family G (WHITE), member 1;
  Uniprot ID:  P45844;
  ENSP ID: ENSP00000381475
MLGTQGWTKQRKPCPQNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 7838 - protein, 257 aa, Homo sapiens
  Payload ID: 1638;
  Gene Symbol: ABCG1;
  Gene Name: ATP-binding cassette, sub-family G (WHITE), member 1;
  ENSP ID: ENSP00000414541
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVKEILTALGLLSCANTRTGSLSGGQRKRLAIALELVNNPPVMFFDEPTSGLDSASCFQVVSLMKGLAQGGRSIICTIH

SEQ ID NO: 7839 - protein, 655 aa, Homo sapiens
  Payload ID: 1639;
  Gene Symbol: ABCG2;
  Gene Name: ATP-binding cassette, sub-family G (WHITE), member 2 (Junior blood group);
  Uniprot ID:  Q9UNQ0;
  ENSP ID: ENSP00000237612
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 7840 - protein, 150 aa, Homo sapiens
  Payload ID: 1639;
  Gene Symbol: ABCG2;
  Gene Name: ATP-binding cassette, sub-family G (WHITE), member 2 (Junior blood group);
  ENSP ID: ENSP00000426916
KRFRARRREEAVPATPTEIERRGKEAACGGTGKIKTLQMSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAP

SEQ ID NO: 7841 - protein, 611 aa, Homo sapiens
  Payload ID: 1639;
  Gene Symbol: ABCG2;
  Gene Name: ATP-binding cassette, sub-family G (WHITE), member 2 (Junior blood group);
  Uniprot ID:  Q9UNQ0;
  ENSP ID: ENSP00000426917
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMVCWSISQPLHLGCHGFSTSAFHDMDLRLCSIMNFWDKTSAQDSMQQETILVTMQHVLAKNIW

SEQ ID NO: 7842 - protein, 130 aa, Homo sapiens
  Payload ID: 1639;
  Gene Symbol: ABCG2;
  Gene Name: ATP-binding cassette, sub-family G (WHITE), member 2 (Junior blood group);
  ENSP ID: ENSP00000426934
SDGDQTQLGQTRKIKTLQMSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAP

SEQ ID NO: 7843 - protein, 152 aa, Homo sapiens
  Payload ID: 1640;
  Gene Symbol: ABCG4;
  Gene Name: ATP-binding cassette, sub-family G (WHITE), member 4;
  ENSP ID: ENSP00000431915
MAEKALEAVGCGLGPGAVAMAVTLEDGAEPPVLTTHLKKVENHITEAQRFSHLPKRSAVDIEFVELSYSVREGPCWRKRGYKTLLKCLSGKFCRRELIGIMGPSGAGKSTFMNILAGYRESGMKGQILVNGRPRELRTFRKMSCYIMQDDML

SEQ ID NO: 7844 - protein, 646 aa, Homo sapiens
  Payload ID: 1640;
  Gene Symbol: ABCG4;
  Gene Name: ATP-binding cassette, sub-family G (WHITE), member 4;
  Uniprot ID:  Q9H172;
  ENSP ID: ENSP00000479253
MAEKALEAVGCGLGPGAVAMAVTLEDGAEPPVLTTHLKKVENHITEAQRFSHLPKRSAVDIEFVELSYSVREGPCWRKRGYKTLLKCLSGKFCRRELIGIMGPSGAGKSTFMNILAGYRESGMKGQILVNGRPRELRTFRKMSCYIMQDDMLLPHLTVLEAMMVSANLKLSEKQEVKKELVTEILTALGLMSCSHTRTALLSGGQRKRLAIALELVNNPPVMFFDEPTSGLDSASCFQVVSLMKSLAQGGRTIICTIHQPSAKLFEMFDKLYILSQGQCIFKGVVTNLIPYLKGLGLHCPTYHNPADFIIEVASGEYGDLNPMLFRAVQNGLCAMAEKKSSPEKNEVPAPCPPCPPEVDPIESHTFATSTLTQFCILFKRTFLSILRDTVLTHLRFMSHVVIGVLIGLLYLHIGDDASKVFNNTGCLFFSMLFLMFAALMPTVLTFPLEMAVFMREHLNYWYSLKAYYLAKTMADVPFQVVCPVVYCSIVYWMTGQPAETSRFLLFSALATATALVAQSLGLLIGAASNSLQVATFVGPVTAIPVLLFSGFFVSFKTIPTYLQWSSYLSYVRYGFEGVILTIYGMERGDLTCLEERCPFREPQSILRALDVEDAKLYMDFLVLGIFFLALRLLAYLVLRYRVKSER

SEQ ID NO: 7845 - protein, 646 aa, Homo sapiens; identical to SEQ ID NO: 7844
  Payload ID: 1640;
  Gene Symbol: ABCG4;
  Gene Name: ATP-binding cassette, sub-family G (WHITE), member 4;
  Uniprot ID:  Q9H172;
  ENSP ID: ENSP00000481728

SEQ ID NO: 7846 - protein, 646 aa, Homo sapiens; identical to SEQ ID NO: 7844
  Payload ID: 1640;
  Gene Symbol: ABCG4;
  Gene Name: ATP-binding cassette, sub-family G (WHITE), member 4;
  Uniprot ID:  Q9H172;
  ENSP ID: ENSP00000484289

SEQ ID NO: 7847 - protein, 651 aa, Homo sapiens
  Payload ID: 1641;
  Gene Symbol: ABCG5;
  Gene Name: ATP-binding cassette, sub-family G (WHITE), member 5;
  Uniprot ID:  Q9H222;
  ENSP ID: ENSP00000260645
MGDLSSLTPGGSMGLQVNRGSQSSLEGAPATAPEPHSLGILHASYSVSHRVRPWWDITSCRQQWTRQILKDVSLYVESGQIMCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPKVMLFDEPTTGLDCMTANQIVVLLVELARRNRIVVLTIHQPRSELFQLFDKIAILSFGELIFCGTPAEMLDFFNDCGYPCPEHSNPFDFYMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 7848 - protein, 480 aa, Homo sapiens
  Payload ID: 1641;
  Gene Symbol: ABCG5;
  Gene Name: ATP-binding cassette, sub-family G (WHITE), member 5;
  ENSP ID: ENSP00000384513
MCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 7849 - protein, 132 aa, Homo sapiens
  Payload ID: 1641;
  Gene Symbol: ABCG5;
  Gene Name: ATP-binding cassette, sub-family G (WHITE), member 5;
  ENSP ID: ENSP00000386501
MCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPRE

SEQ ID NO: 7850 - protein, 118 aa, Homo sapiens
  Payload ID: 1641;
  Gene Symbol: ABCG5;
  Gene Name: ATP-binding cassette, sub-family G (WHITE), member 5;
  ENSP ID: ENSP00000430935
MCILGSSGSGKTTLLDAMSGRLGRAGTFLGEVYVNGRALRREQFQDCFSYVLQSDTLLSSLTVRETLHYTALLAIRRGNPGSFQKKRQGLSLLPKLVSNSWPQAILPPQPSKVLGLQA

SEQ ID NO: 7851 - protein, 673 aa, Homo sapiens
  Payload ID: 1642;
  Gene Symbol: ABCG8;
  Gene Name: ATP-binding cassette, sub-family G (WHITE), member 8;
  Uniprot ID:  Q9H221;
  ENSP ID: ENSP00000272286
MAGKAAEERGLPKGATPQDTSGLQDRLFSSESDNSLYFTYSGQPNTLEVRDLNYQVDLASQVPWFEQLAQFKMPWTSPSCQNSCELGIQNLSFKVRSGQMLAIIGSSGCGRASLLDVITGRGHGGKIKSGQIWINGQPSSPQLVRKCVAHVRQHNQLLPNLTVRETLAFIAQMRLPRTFSQAQRDKRVEDVIAELRLRQCADTRVGNMYVRGLSGGERRRVSIGVQLLWNPGILILDEPTSGLDSFTAHNLVKTLSRLAKGNRLVLISLHQPRSDIFRLFDLVLLMTSGTPIYLGAAQHMVQYFTAIGYPCPRYSNPADFYVDLTSIDRRSREQELATREKAQSLAALFLEKVRDLDDFLWKAETKDLDEDTCVESSVTPLDTNCLPSPTKMPGAVQQFTTLIRRQISNDFRDLPTLLIHGAEACLMSMTIGFLYFGHGSIQLSFMDTAALLFMIGALIPFNVILDVISKCYSERAMLYYELEDGLYTTGPYFFAKILGELPEHCAYIIIYGMPTYWLANLRPGLQPFLLHFLLVWLVVFCCRIMALAAAALLPTFHMASFFSNALYNSFYLAGGFMINLSSLWTVPAWISKVSFLRWCFEGLMKIQFSRRTYKMPLGNLTIAVSGDKILSVMELDSYPLYAIYLIVIGLSGGFMVLYYVSLRFIKQKPSQDW

SEQ ID NO: 7852 - protein, 764 aa, Homo sapiens
  Payload ID: 1643;
  Gene Symbol: ATRIP;
  Gene Name: ATR interacting prt;
  Uniprot ID:  Q8WXE1;
  ENSP ID: ENSP00000302338
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 7853 - protein, 791 aa, Homo sapiens
  Payload ID: 1643;
  Gene Symbol: ATRIP;
  Gene Name: ATR interacting prt;
  Uniprot ID:  Q8WXE1;
  ENSP ID: ENSP00000323099
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 7854 - protein, 698 aa, Homo sapiens
  Payload ID: 1643;
  Gene Symbol: ATRIP;
  Gene Name: ATR interacting prt;
  Uniprot ID:  Q8WXE1;
  ENSP ID: ENSP00000400930
MSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 7855 - protein, 131 aa, Homo sapiens
  Payload ID: 1643;
  Gene Symbol: ATRIP;
  Gene Name: ATR interacting prt;
  ENSP ID: ENSP00000489136
MSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVR

SEQ ID NO: 7856 - protein, 196 aa, Homo sapiens
  Payload ID: 1643;
  Gene Symbol: ATRIP;
  Gene Name: ATR interacting prt;
  ENSP ID: ENSP00000489608
MSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIK

SEQ ID NO: 7857 - protein, 314 aa, Homo sapiens
  Payload ID: 1644;
  Gene Symbol:;
  Gene Name: ATR interacting prt [Source:EntrezGene;Acc:84126];
  Uniprot ID:  Q9NSU2;
  ENSP ID: ENSP00000296443
MGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 7858 - protein, 664 aa, Homo sapiens
  Payload ID: 1644;
  Gene Symbol:;
  Gene Name: ATR interacting prt [Source:EntrezGene;Acc:84126];
  Uniprot ID:  Q8WXE1;
  ENSP ID: ENSP00000349620
MKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 7859 - protein, 46 aa, Homo sapiens
  Payload ID: 1644;
  Gene Symbol:;
  Gene Name: ATR interacting prt [Source:EntrezGene;Acc:84126];
  ENSP ID: ENSP00000489041
MSKNPSGKNRETVPIKDNFELEVLQAQYKELKEKLCKKADTSYHHL

SEQ ID NO: 7860 - protein, 464 aa, Homo sapiens
  Payload ID: 1644;
  Gene Symbol:;
  Gene Name: ATR interacting prt [Source:EntrezGene;Acc:84126];
  ENSP ID: ENSP00000489199
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCQQVTFKPVS

SEQ ID NO: 7861 - protein, 2644 aa, Homo sapiens
  Payload ID: 1645;
  Gene Symbol: ATR;
  Gene Name: ATR serine/threonine kinase;
  Uniprot ID:  Q13535;
  ENSP ID: ENSP00000343741
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 7862 - protein, 39 aa, Homo sapiens
  Payload ID: 1645;
  Gene Symbol: ATR;
  Gene Name: ATR serine/threonine kinase;
  ENSP ID: ENSP00000421870
APLNETGEVVNEKVSRRWQVLQIHLSNVKFVLQRVLPLI

SEQ ID NO: 7863 - protein, 80 aa, Homo sapiens
  Payload ID: 1645;
  Gene Symbol: ATR;
  Gene Name: ATR serine/threonine kinase;
  ENSP ID: ENSP00000422553
HNMVNGMGPMGTEGLFRRACEVTMRLMRDQREPLMSVLKTFLHDPLVEWSKPVKGHSKAPLNETGEVVNEKMASSSNSFK

SEQ ID NO: 7864 - protein, 457 aa, Homo sapiens
  Payload ID: 1645;
  Gene Symbol: ATR;
  Gene Name: ATR serine/threonine kinase;
  ENSP ID: ENSP00000424355
  MOD_RES (1)..(1): Any amino acid
XEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKVSRRYSLIWAVVLISTNELDMQL

SEQ ID NO: 7865 - protein, 309 aa, Homo sapiens
  Payload ID: 1645;
  Gene Symbol: ATR;
  Gene Name: ATR serine/threonine kinase;
  ENSP ID: ENSP00000425897
MLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEDRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKIL

SEQ ID NO: 7866 - protein, 100 aa, Homo sapiens
  Payload ID: 1645;
  Gene Symbol: ATR;
  Gene Name: ATR serine/threonine kinase;
  ENSP ID: ENSP00000426595
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIVFP

SEQ ID NO: 7867 - protein, 1190 aa, Homo sapiens
  Payload ID: 1646;
  Gene Symbol: ATN1;
  Gene Name: atrophin 1;
  Uniprot ID:  P54259;
  ENSP ID: ENSP00000349076
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSARFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 7868 - protein, 1190 aa, Homo sapiens; identical to SEQ ID NO: 7867
  Payload ID: 1646;
  Gene Symbol: ATN1;
  Gene Name: atrophin 1;
  Uniprot ID:  P54259;
  ENSP ID: ENSP00000379915

SEQ ID NO: 7869 - protein, 1429 aa, Homo sapiens
  Payload ID: 1647;
  Gene Symbol: ATRN;
  Gene Name: attractin;
  Uniprot ID:  O75882;
  ENSP ID: ENSP00000262919
MVAAAAATEARLRRRTAATAALAGRSGGPHWDWDVTRAGRPGLGAGLRLPRLLSPPLRPRLLLLLLLLSPPLLLLLLPCEAEAAAAAAAVSGSAAAEAKECDRPCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQIAFSQHSNFMDLVQFFVTFFSCFLSLLLVAAVVWKIKQSCWASRRREQLLREMQQMASRPFASVNVALETDEEPPDLIGGSIKTVPKPIALEPCFGNKAAVLSVFVRLPRGLGGIPPPGQSGLAVASALVDISQQMPIVYKEKSGAVRNRKQQPPAQPGTCI

SEQ ID NO: 7870 - protein, 1272 aa, Homo sapiens
  Payload ID: 1647;
  Gene Symbol: ATRN;
  Gene Name: attractin;
  Uniprot ID:  O75882;
  ENSP ID: ENSP00000416587
MVAAAAATEARLRRRTAATAALAGRSGGPHWDWDVTRAGRPGLGAGLRLPRLLSPPLRPRLLLLLLLLSPPLLLLLLPCEAEAAAAAAAVSGSAAAEAKECDRPCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQVQTEQ

SEQ ID NO: 7871 - protein, 1379 aa, Homo sapiens
  Payload ID: 1648;
  Gene Symbol: ATRNL1;
  Gene Name: attractin-like 1;
  Uniprot ID:  Q5VV63;
  ENSP ID: ENSP00000347152
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLNYNLESSIWNVGTPSRGPLQRYGHSLALYQENIFMYGGRIETNDGNVTDELWVFNIHSQSWSTKTPTVLGHGQQYAVEGHSAHIMELDSRDVVMIIIFGYSAIYGYTSSIQEYHISSNTWLVPETKGAIVQGGYGHTSVYDEITKSIYVHGGYKALPGNKYGLVDDLYKYEVNTKTWTILKESGFARYLHSAVLINGAMLIFGGNTHNDTSLSNGAKCFSADFLAYDIACDEWKILPKPNLHRDVNRFGHSAVVINGSMYIFGGFSSVLLNDILVYKPPNCKAFRDEELCKNAGPGIKCVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYYSLLIDYQFTFSLLQEDDRHHTAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 7872 - protein, 252 aa, Homo sapiens
  Payload ID: 1648;
  Gene Symbol: ATRNL1;
  Gene Name: attractin-like 1;
  ENSP ID: ENSP00000431423
MPECDWRQPSGGDGGWDLSLLTGERDSDGRRLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWV

SEQ ID NO: 7873 - protein, 216 aa, Homo sapiens
  Payload ID: 1648;
  Gene Symbol: ATRNL1;
  Gene Name: attractin-like 1;
  ENSP ID: ENSP00000434118
  MOD_RES (1)..(1): Any amino acid
XCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACTCSGHANICHLHTGKCFCTTKGIKGDQCQLCDSENRYVGNPLRGTCYYSLLIDYQFTFSLLQEDDRHHTAIN

SEQ ID NO: 7874 - protein, 398 aa, Homo sapiens
  Payload ID: 1648;
  Gene Symbol: ATRNL1;
  Gene Name: attractin-like 1;
  ENSP ID: ENSP00000473412
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLKKTSLCMEAELKQMMAMSQMNYGFLTYIVSHGVQKLLLFLDMVSSMLWRDIQHILWSWIVEMLS

SEQ ID NO: 7875 - protein, 467 aa, Homo sapiens
  Payload ID: 1648;
  Gene Symbol: ATRNL1;
  Gene Name: attractin-like 1;
  Uniprot ID:  Q5VV63;
  ENSP ID: ENSP00000476902
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLNYNLESSIWNVGTPSRGPLQRYGHSLALYQENIFMYGGRIETNDGNVTDELWVFNIHSQSWSTKTPTVLGHGQQYAVEGHSAHIMELDSRDVVMIIIFGYSAIYGYTSSIQEYHICELLKNCNFFIDWECFSL

SEQ ID NO: 7876 - protein, 36 aa, Homo sapiens
  Payload ID: 1648;
  Gene Symbol: ATRNL1;
  Gene Name: attractin-like 1;
  ENSP ID: ENSP00000483722
MPECDWRQPSGGDGGWDLSLLTGERDSDGRRDFARE

SEQ ID NO: 7877 - protein, 338 aa, Homo sapiens
  Payload ID: 1649;
  Gene Symbol: ACKR1;
  Gene Name: atypical chemokine receptor 1 (Duffy blood group);
  Uniprot ID:  Q16570;
  ENSP ID: ENSP00000357103
MASSGYVLQAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 7878 - protein, 336 aa, Homo sapiens
  Payload ID: 1649;
  Gene Symbol: ACKR1;
  Gene Name: atypical chemokine receptor 1 (Duffy blood group);
  Uniprot ID:  Q16570;
  ENSP ID: ENSP00000357104
MGNCLHRAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 7879 - protein, 155 aa, Homo sapiens
  Payload ID: 1649;
  Gene Symbol: ACKR1;
  Gene Name: atypical chemokine receptor 1 (Duffy blood group);
  ENSP ID: ENSP00000398406
MASSGYVLQAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASL

SEQ ID NO: 7880 - protein, 336 aa, Homo sapiens; identical to SEQ ID NO: 7878
  Payload ID: 1649;
  Gene Symbol: ACKR1;
  Gene Name: atypical chemokine receptor 1 (Duffy blood group);
  Uniprot ID:  Q16570;
  ENSP ID: ENSP00000441985

SEQ ID NO: 7881 - protein, 384 aa, Homo sapiens
  Payload ID: 1650;
  Gene Symbol: ACKR2;
  Gene Name: atypical chemokine receptor 2;
  Uniprot ID:  O00590;
  ENSP ID: ENSP00000396150
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 7882 - protein, 384 aa, Homo sapiens; identical to SEQ ID NO: 7881
  Payload ID: 1650;
  Gene Symbol: ACKR2;
  Gene Name: atypical chemokine receptor 2;
  Uniprot ID:  O00590;
  ENSP ID: ENSP00000416996

SEQ ID NO: 7883 - protein, 233 aa, Homo sapiens
  Payload ID: 1650;
  Gene Symbol: ACKR2;
  Gene Name: atypical chemokine receptor 2;
  ENSP ID: ENSP00000476581
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRI

SEQ ID NO: 7884 - protein, 124 aa, Homo sapiens
  Payload ID: 1650;
  Gene Symbol: ACKR2;
  Gene Name: atypical chemokine receptor 2;
  ENSP ID: ENSP00000476901
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLY

SEQ ID NO: 7885 - protein, 170 aa, Homo sapiens
  Payload ID: 1650;
  Gene Symbol: ACKR2;
  Gene Name: atypical chemokine receptor 2;
  ENSP ID: ENSP00000477157
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWA

SEQ ID NO: 7886 - protein, 142 aa, Homo sapiens
  Payload ID: 1650;
  Gene Symbol: ACKR2;
  Gene Name: atypical chemokine receptor 2;
  ENSP ID: ENSP00000477475
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDK

SEQ ID NO: 7887 - protein, 362 aa, Homo sapiens
  Payload ID: 1651;
  Gene Symbol: ACKR3;
  Gene Name: atypical chemokine receptor 3;
  Uniprot ID:  P25106;
  ENSP ID: ENSP00000272928
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 7888 - protein, 210 aa, Homo sapiens
  Payload ID: 1651;
  Gene Symbol: ACKR3;
  Gene Name: atypical chemokine receptor 3;
  ENSP ID: ENSP00000405945
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLI

SEQ ID NO: 7889 - protein, 350 aa, Homo sapiens
  Payload ID: 1652;
  Gene Symbol: ACKR4;
  Gene Name: atypical chemokine receptor 4;
  Uniprot ID:  Q9NPB9;
  ENSP ID: ENSP00000249887
MALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPYNIVKFCRAIDIIYSLITSCNMSKRMDIAIQVTESIALFHSCLNPILYVFMGASFKNYVMKVAKKYGSWRRQRQSVEEFPFDSEGPTEPTSTFSI

SEQ ID NO: 7890 - protein, 20 aa, Homo sapiens
  Payload ID: 1652;
  Gene Symbol: ACKR4;
  Gene Name: atypical chemokine receptor 4;
  ENSP ID: ENSP00000425557
VEEFPFDSEGPTEPTSTFSI

SEQ ID NO: 7891 - protein, 310 aa, Homo sapiens
  Payload ID: 1653;
  Gene Symbol: AUH;
  Gene Name: AU RNA binding prt/enoyl-CoA hydratase;
  Uniprot ID:  Q13825;
  ENSP ID: ENSP00000307334
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 7892 - protein, 339 aa, Homo sapiens
  Payload ID: 1653;
  Gene Symbol: AUH;
  Gene Name: AU RNA binding prt/enoyl-CoA hydratase;
  Uniprot ID:  Q13825;
  ENSP ID: ENSP00000364883
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 7893 - protein, 403 aa, Homo sapiens
  Payload ID: 1654;
  Gene Symbol: AURKA;
  Gene Name: aurora kinase A;
  Uniprot ID:  O14965;
  ENSP ID: ENSP00000216911
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 7894 - protein, 403 aa, Homo sapiens; identical to SEQ ID NO: 7893
  Payload ID: 1654;
  Gene Symbol: AURKA;
  Gene Name: aurora kinase A;
  Uniprot ID:  O14965;
  ENSP ID: ENSP00000321591

SEQ ID NO: 7895 - protein, 403 aa, Homo sapiens; identical to SEQ ID NO: 7893
  Payload ID: 1654;
  Gene Symbol: AURKA;
  Gene Name: aurora kinase A;
  Uniprot ID:  O14965;
  ENSP ID: ENSP00000360407

SEQ ID NO: 7896 - protein, 347 aa, Homo sapiens
  Payload ID: 1654;
  Gene Symbol: AURKA;
  Gene Name: aurora kinase A;
  ENSP ID: ENSP00000379243
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVRRN

SEQ ID NO: 7897 - protein, 403 aa, Homo sapiens; identical to SEQ ID NO: 7893
  Payload ID: 1654;
  Gene Symbol: AURKA;
  Gene Name: aurora kinase A;
  Uniprot ID:  O14965;
  ENSP ID: ENSP00000379247

SEQ ID NO: 7898 - protein, 403 aa, Homo sapiens; identical to SEQ ID NO: 7893
  Payload ID: 1654;
  Gene Symbol: AURKA;
  Gene Name: aurora kinase A;
  Uniprot ID:  O14965;
  ENSP ID: ENSP00000379249

SEQ ID NO: 7899 - protein, 403 aa, Homo sapiens; identical to SEQ ID NO: 7893
  Payload ID: 1654;
  Gene Symbol: AURKA;
  Gene Name: aurora kinase A;
  Uniprot ID:  O14965;
  ENSP ID: ENSP00000379250

SEQ ID NO: 7900 - protein, 403 aa, Homo sapiens; identical to SEQ ID NO: 7893
  Payload ID: 1654;
  Gene Symbol: AURKA;
  Gene Name: aurora kinase A;
  Uniprot ID:  O14965;
  ENSP ID: ENSP00000379251

SEQ ID NO: 7901 - protein, 188 aa, Homo sapiens
  Payload ID: 1654;
  Gene Symbol: AURKA;
  Gene Name: aurora kinase A;
  ENSP ID: ENSP00000388073
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHL

SEQ ID NO: 7902 - protein, 271 aa, Homo sapiens
  Payload ID: 1654;
  Gene Symbol: AURKA;
  Gene Name: aurora kinase A;
  ENSP ID: ENSP00000393452
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELK

SEQ ID NO: 7903 - protein, 79 aa, Homo sapiens
  Payload ID: 1654;
  Gene Symbol: AURKA;
  Gene Name: aurora kinase A;
  ENSP ID: ENSP00000401358
MDRSKENCISGPVKATAPVGGPKRVLVTQQFPCQNPLPVNSGQAQRVLCPSNSSQRIPLQAQKLVSSHKPVQNQKQKQL

SEQ ID NO: 7904 - protein, 146 aa, Homo sapiens
  Payload ID: 1654;
  Gene Symbol: AURKA;
  Gene Name: aurora kinase A;
  ENSP ID: ENSP00000405042
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGN

SEQ ID NO: 7905 - protein, 106 aa, Homo sapiens
  Payload ID: 1654;
  Gene Symbol: AURKA;
  Gene Name: aurora kinase A;
  ENSP ID: ENSP00000405170
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAP

SEQ ID NO: 7906 - protein, 357 aa, Homo sapiens
  Payload ID: 1655;
  Gene Symbol: AUNIP;
  Gene Name: aurora kinase A and ninein interacting prt;
  Uniprot ID:  Q9H7T9;
  ENSP ID: ENSP00000363416
MRRTGPEEEACGVWLDAAALKRRKVQTHLIKPGTKMLTLLPGERKANIYFTQRRAPSTGIHQRSIASFFTLQPGKTNGSDQKSVSSHTESQINKESKKNATQLDHLIPGLAHDCMASPLATSTTADIQEAGLSPQSLQTSGHHRMKTPFSTELSLLQPDTPDCAGDSHTPLAFSFTEDLESSCLLDRKEEKGDSARKWEWLHESKKNYQSMEKHTKLPGDKCCQPLGKTKLERKVSAKENRQAPVLLQTYRESWNGENIESVKQSRSPVSVFSWDNEKNDKDSWSQLFTEDSQGQRVIAHNTRAPFQDVTNNWNWDLGPFPNSPWAQCQEDGPTQNLKPDLLFTQDSEGNQVIRHQF

SEQ ID NO: 7907 - protein, 371 aa, Homo sapiens
  Payload ID: 1655;
  Gene Symbol: AUNIP;
  Gene Name: aurora kinase A and ninein interacting prt;
  Uniprot ID:  Q9H7T9;
  ENSP ID: ENSP00000443647
MRRTGPEEEACGVWLDAAALKRRKVQTHLIKPGTKMLTLLPGERKANIYFTQRRAPSTGIHQRSIASFFTLQPGKTNGSDQKSVSSHTESQINKESKKNATQLDHLIPGLAHDCMASPLATSTTADIQEAGLSPQSLQTSGHHRMKTPFSTELSLLQPDTPDCAGDSHTPLAFSFTEDLESSCLLDRKEEKGDSARKWEWLHESKKNYQSMEKHTKLPGDKCCQPLGKTKLERKVSAKENRQAPVLLQTYRESWNGENIESVKQSRSPVSVFSWDNEKNDKDSWSQLFTEDSQGQRVIAHNTRAPFQDVTNNWNWDLGPFPNSPWAQCQEDGPTQNLKPDLLFTQDSEVQALACQQDCCRRSILKRQKHLR

SEQ ID NO: 7908 - protein, 199 aa, Homo sapiens
  Payload ID: 1656;
  Gene Symbol: AURKAIP1;
  Gene Name: aurora kinase A interacting prt 1;
  Uniprot ID:  Q9NWT8;
  ENSP ID: ENSP00000319778
MLLGRLTSQLLRAVPWAGGRPPWPVSGVLGSRVCGPLYSTSPAGPGRAASLPRKGAQLELEEMLVPRKMSVSPLESWLTARCFLPRLDTGTAGTVAPPQSYQCPPSQIGEGAEQGDEGVADAPQIQCKNVLKIRRRKMNHHKYRKLVKKTRFLRRKVQEGRLRRKQIKFEKDLRRIWLKAGLKEAPEGWQTPKIYLRGK

SEQ ID NO: 7909 - protein, 199 aa, Homo sapiens; identical to SEQ ID NO: 7908
  Payload ID: 1656;
  Gene Symbol: AURKAIP1;
  Gene Name: aurora kinase A interacting prt 1;
  Uniprot ID:  Q9NWT8;
  ENSP ID: ENSP00000340656

SEQ ID NO: 7910 - protein, 199 aa, Homo sapiens; identical to SEQ ID NO: 7908
  Payload ID: 1656;
  Gene Symbol: AURKAIP1;
  Gene Name: aurora kinase A interacting prt 1;
  Uniprot ID:  Q9NWT8;
  ENSP ID: ENSP00000342676

SEQ ID NO: 7911 - protein, 199 aa, Homo sapiens; identical to SEQ ID NO: 7908
  Payload ID: 1656;
  Gene Symbol: AURKAIP1;
  Gene Name: aurora kinase A interacting prt 1;
  Uniprot ID:  Q9NWT8;
  ENSP ID: ENSP00000368130

SEQ ID NO: 7912 - protein, 345 aa, Homo sapiens
  Payload ID: 1657;
  Gene Symbol: AURKB;
  Gene Name: aurora kinase B;
  Uniprot ID:  Q96GD4;
  ENSP ID: ENSP00000313950
MAQKENSYPWPYGRQTAPSGLSTLPQRVLRKEPVTPSALVLMSRSNVQPTAAPGQKVMENSSGTPDILTRRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 7913 - protein, 303 aa, Homo sapiens
  Payload ID: 1657;
  Gene Symbol: AURKB;
  Gene Name: aurora kinase B;
  Uniprot ID:  Q96GD4;
  ENSP ID: ENSP00000443869
MSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 7914 - protein, 123 aa, Homo sapiens
  Payload ID: 1657;
  Gene Symbol: AURKB;
  Gene Name: aurora kinase B;
  ENSP ID: ENSP00000461981
MAQKENSYPWPYGRQTAPSGLSTLPQRVLRKEPVTPSALVLMSRSNVQPTAAPGQKVMENSSGTPDILTRHFTIDDFEIGRPLGKDHGGVGRCSNVLPWEEGDSQRHKARKSALRAQGRAEDC

SEQ ID NO: 7915 - protein, 69 aa, Homo sapiens
  Payload ID: 1657;
  Gene Symbol: AURKB;
  Gene Name: aurora kinase B;
  ENSP ID: ENSP00000462027
MSRSNVQPTAAPGQKVMENSSGTPDILTRHFTIDDFEIGRPLGKGKFGNVYLAREKKSHFIVALKVLFK

SEQ ID NO: 7916 - protein, 312 aa, Homo sapiens
  Payload ID: 1657;
  Gene Symbol: AURKB;
  Gene Name: aurora kinase B;
  Uniprot ID:  Q96GD4;
  ENSP ID: ENSP00000462207
MAQKENSYPWPYGRQTAPSGLSTLPQRVLRKEPVTPSALVLMSRSNVQPTAAPGQKVMENSSGTPDILTRHFTIDDFEIGRPLGKALLCLWPEASSVSSPSHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 7917 - protein, 242 aa, Homo sapiens
  Payload ID: 1657;
  Gene Symbol: AURKB;
  Gene Name: aurora kinase B;
  ENSP ID: ENSP00000462858
  MOD_RES (1)..(1): Any amino acid
XRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLKFPASVPMGAQDLISKLLRHNPSERLPLAQVSAHPWVRANSRRVLPPSALQSVA

SEQ ID NO: 7918 - protein, 228 aa, Homo sapiens
  Payload ID: 1657;
  Gene Symbol: AURKB;
  Gene Name: aurora kinase B;
  ENSP ID: ENSP00000462930
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSL

SEQ ID NO: 7919 - protein, 230 aa, Homo sapiens
  Payload ID: 1657;
  Gene Symbol: AURKB;
  Gene Name: aurora kinase B;
  ENSP ID: ENSP00000463636
MSRSNVQPTAAPGQKVMENSSGTPDILTRRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGN

SEQ ID NO: 7920 - protein, 344 aa, Homo sapiens
  Payload ID: 1657;
  Gene Symbol: AURKB;
  Gene Name: aurora kinase B;
  Uniprot ID:  Q96GD4;
  ENSP ID: ENSP00000463999
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 7921 - protein, 172 aa, Homo sapiens
  Payload ID: 1657;
  Gene Symbol: AURKB;
  Gene Name: aurora kinase B;
  ENSP ID: ENSP00000464031
MSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGE

SEQ ID NO: 7922 - protein, 309 aa, Homo sapiens
  Payload ID: 1658;
  Gene Symbol: AURKC;
  Gene Name: aurora kinase C;
  Uniprot ID:  Q9UQB9;
  ENSP ID: ENSP00000302898
MSSPRAVVQLGKAQPAGEELATANQTAQQPSSPAMRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 7923 - protein, 274 aa, Homo sapiens
  Payload ID: 1658;
  Gene Symbol: AURKC;
  Gene Name: aurora kinase C;
  ENSP ID: ENSP00000406798
MRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHPLPERKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 7924 - protein, 290 aa, Homo sapiens
  Payload ID: 1658;
  Gene Symbol: AURKC;
  Gene Name: aurora kinase C;
  Uniprot ID:  Q9UQB9;
  ENSP ID: ENSP00000407162
MATANQTAQQPSSPAMRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 7925 - protein, 46 aa, Homo sapiens
  Payload ID: 1658;
  Gene Symbol: AURKC;
  Gene Name: aurora kinase C;
  ENSP ID: ENSP00000468918
MSSPRAVVQLGKAQPAGEECESQRQRKDAGKAGDWARGRVHRRHMC

SEQ ID NO: 7926 - protein, 137 aa, Homo sapiens
  Payload ID: 1658;
  Gene Symbol: AURKC;
  Gene Name: aurora kinase C;
  ENSP ID: ENSP00000469894
RGELYKELQKSEKLDEQRTATVRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 7927 - protein, 306 aa, Homo sapiens
  Payload ID: 1658;
  Gene Symbol: AURKC;
  Gene Name: aurora kinase C;
  ENSP ID: ENSP00000469983
MSSPRAVVQLGKAQPAGEESNQTAQQPSSPAMRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 7928 - protein, 113 aa, Homo sapiens
  Payload ID: 1658;
  Gene Symbol: AURKC;
  Gene Name: aurora kinase C;
  ENSP ID: ENSP00000470465
MRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATVR

SEQ ID NO: 7929 - protein, 275 aa, Homo sapiens
  Payload ID: 1658;
  Gene Symbol: AURKC;
  Gene Name: aurora kinase C;
  Uniprot ID:  Q9UQB9;
  ENSP ID: ENSP00000471830
MRRLTVDDFEIGRPLGKGKFGNVYLARLKESHFIVALKVLFKSQIEKEGLEHQLRREIEIQAHLQHPNILRLYNYFHDARRVYLILEYAPRGELYKELQKSEKLDEQRTATIIEELADALTYCHDKKVIHRDIKPENLLLGFRGEVKIADFGWSVHTPSLRRKTMCGTLDYLPPEMIEGRTYDEKVDLWCIGVLCYELLVGYPPFESASHSETYRRILKVDVRFPLSMPLGARDLISRLLRYQPLERLPLAQILKHPWVQAHSRRVLPPCAQMAS

SEQ ID NO: 7930 - protein, 1259 aa, Homo sapiens
  Payload ID: 1659;
  Gene Symbol: AUTS2;
  Gene Name: autism susceptibility candidate 2;
  Uniprot ID:  Q8WXX7;
  ENSP ID: ENSP00000344087
MDGPTRGHGLRKKRRSRSQRDRERRSRGGLGAGAAGGGGAGRTRALSLASSSGSDKEDNGKPPSSAPSRPRPPRRKRRESTSAEEDIIDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFCDSDSDQEEKASDASSEKLFNTVIVNKDPELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSLFHSYPPAVSGIPPMIPPTGPFGSLQGAFQPKTSNPIDVAARPGTVPHTLLQKDPRLTDPFRPMLRKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 7931 - protein, 1235 aa, Homo sapiens
  Payload ID: 1659;
  Gene Symbol: AUTS2;
  Gene Name: autism susceptibility candidate 2;
  Uniprot ID:  Q8WXX7;
  ENSP ID: ENSP00000385263
MDGPTRGHGLRKKRRSRSQRDRERRSRGGLGAGAAGGGGAGRTRALSLASSSGSDKEDNGKPPSSAPSRPRPPRRKRRESTSAEEDIIDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFCDSDSDQEEKASDASSEKLFNTVIVNKDPELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSLFHSYPPAVSGIPPMIPPTGPFGSLQGAFQPKLTDPFRPMLRKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 7932 - protein, 266 aa, Homo sapiens
  Payload ID: 1659;
  Gene Symbol: AUTS2;
  Gene Name: autism susceptibility candidate 2;
  Uniprot ID:  Q8WXX7;
  ENSP ID: ENSP00000385572
MDGPTRGHGLRKKRRSRSQRDRERRSRGGLGAGAAGGGGAGRTRALSLASSSGSDKEDNGKPPSSAPSRPRPPRRKRRESTSAEEDIIDGFAMTSFVTFEALEKDVALKPQERVEKRQTPLTKKKREALTNGLSFHSKKSRLSHPHHYSSDRENDRNLCQHLGKRKKMPKALRQLKPGQNSCRDSDSESASGESKGFHRSSSRERLSDSSAPSSLGTGYFRSGKMCLGEEACLKSGNDMKRDVSNTSSWASNRESFFSLVKLLKGF

SEQ ID NO: 7933 - protein, 183 aa, Homo sapiens
  Payload ID: 1659;
  Gene Symbol: AUTS2;
  Gene Name: autism susceptibility candidate 2;
  ENSP ID: ENSP00000392333
TLWRGVILHLTAPINESLPNKEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKD

SEQ ID NO: 7934 - protein, 181 aa, Homo sapiens
  Payload ID: 1659;
  Gene Symbol: AUTS2;
  Gene Name: autism susceptibility candidate 2;
  ENSP ID: ENSP00000393548
  MOD_RES (1)..(1): Any amino acid
XFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMLFHSYPPAVSGIPPMIPPTGPFGSLQGAFQPKTSNPIDVAARPGTVPHTLLQKDPRLTDPFRPMLRKPGKWCAMHV

SEQ ID NO: 7935 - protein, 199 aa, Homo sapiens
  Payload ID: 1659;
  Gene Symbol: AUTS2;
  Gene Name: autism susceptibility candidate 2;
  ENSP ID: ENSP00000394887
  MOD_RES (1)..(1): Any amino acid
XSFSPGAFQSLWRPVPGVGLGAPVPMVKDPELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSRSSTPAKTQPAP

SEQ ID NO: 7936 - protein, 100 aa, Homo sapiens
  Payload ID: 1659;
  Gene Symbol: AUTS2;
  Gene Name: autism susceptibility candidate 2;
  ENSP ID: ENSP00000400227
  MOD_RES (1)..(1): Any amino acid
XDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNNMYSF

SEQ ID NO: 7937 - protein, 62 aa, Homo sapiens
  Payload ID: 1659;
  Gene Symbol: AUTS2;
  Gene Name: autism susceptibility candidate 2;
  ENSP ID: ENSP00000407058
  MOD_RES (1)..(1): Any amino acid
XDRSFQTYVKETREVVCYACSHRLADLPPPTESQGQSDLRGVGKNGMHINRCSQTHISWTLD

SEQ ID NO: 7938 - protein, 1011 aa, Homo sapiens
  Payload ID: 1659;
  Gene Symbol: AUTS2;
  Gene Name: autism susceptibility candidate 2;
  ENSP ID: ENSP00000478134
PELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSLFHSYPPAVSGIPPMIPPTGPFGSLQGAFQPKTSNPIDVAARPGTVPHTLLQKDPRLTDPFRPMLRKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 7939 - protein, 987 aa, Homo sapiens
  Payload ID: 1659;
  Gene Symbol: AUTS2;
  Gene Name: autism susceptibility candidate 2;
  ENSP ID: ENSP00000479325
PELGVGTLPEHDSQDAGPIVPKISGLERSQEKSQDCCKEPIFEPVVLKDPCPQVAQPIPQPQTEPQLRAPSPDPDLVQRTEAPPQPPPLSTQPPQGPPEAQLQPAPQPQVQRPPRPQSPTQLLHQNLPPVQAHPSAQSLSQPLSAYNSSSLSLNSLSSSRSSTPAKTQPAPPHISHHPSASPFPLSLPNHSPLHSFTPTLQPPAHSHHPNMFAPPTALPPPPPLTSGSLQVAGHPAGSTYSEQDILRQELNTRFLASQSADRGASLGPPPYLRTEFHQHQHQHQHTHQHTHQHTFTPFPHAIPPTAIMPTPAPPMFDKYPTKVDPFYRHSLFHSYPPAVSGIPPMIPPTGPFGSLQGAFQPKLTDPFRPMLRKPGKWCAMHVHIAWQIYHHQQKVKKQMQSDPHKLDFGLKPEFLSRPPGPSLFGAIHHPHDLARPSTLFSAAGAAHPTGTPFGPPPHHSNFLNPAAHLEPFNRPSTFTGLAAVGGNAFGGLGNPSVTPNSMFGHKDGPSVQNFSNPHEPWNRLHRTPPSFPTPPPWLKPGELERSASAAAHDRDRDVDKRDSSVSKDDKERESVEKRHSSHPSPAPVLPVNALGHTRSSTEQIRAHLNTEAREKDKPKERERDHSESRKDLAADEHKAKEGHLPEKDGHGHEGRAAGEEAKQLARVPSPYVRTPVVESARPNSTSSREAEPRKGEPAYENPKKSSEVKVKEERKEDHDLPPEAPQTHRASEPPPPNSSSSVHPGPLASMPMTVGVTGIHPMNSISSLDRTRMMTPFMGISPLPGGERFPYPSFHWDPIRDPLRDPYRELDIHRRDPLGRDFLLRNDPLHRLSTPRLYEADRSFRDREPHDYSHHHHHHHHPLSVDPRREHERGGHLDERERLHMLREDYEHTRLHSVHPASLDGHLPHPSLITPGLPSMHYPRISPTAGNQNGLLNKTPPTAALSAPPPLISTLGGRPVSPRRTTPLSAEIRERPPSHTLKDIEAR

SEQ ID NO: 7940 - protein, 643 aa, Homo sapiens
  Payload ID: 1660;
  Gene Symbol: AMFR;
  Gene Name: autocrine motility  factor receptor, E3 ubiquitin prt ligase;
  Uniprot ID:  Q9UKV5;
  ENSP ID: ENSP00000290649
MPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 7941 - protein, 165 aa, Homo sapiens
  Payload ID: 1660;
  Gene Symbol: AMFR;
  Gene Name: autocrine motility  factor receptor, E3 ubiquitin prt ligase;
  ENSP ID: ENSP00000455842
MLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYT

SEQ ID NO: 7942 - protein, 288 aa, Homo sapiens
  Payload ID: 1660;
  Gene Symbol: AMFR;
  Gene Name: autocrine motility  factor receptor, E3 ubiquitin prt ligase;
  ENSP ID: ENSP00000456288
WLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGDDSSMRVTAPEDVPVGQEVEVVDSDTDAPDLWSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDL

SEQ ID NO: 7943 - protein, 229 aa, Homo sapiens
  Payload ID: 1660;
  Gene Symbol: AMFR;
  Gene Name: autocrine motility  factor receptor, E3 ubiquitin prt ligase;
  ENSP ID: ENSP00000456745
MLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEA

SEQ ID NO: 7944 - protein, 299 aa, Homo sapiens
  Payload ID: 1660;
  Gene Symbol: AMFR;
  Gene Name: autocrine motility  factor receptor, E3 ubiquitin prt ligase;
  ENSP ID: ENSP00000473636
YLATSGYPWPAWSSLCSCVTCFMRCNVEFVGTRTIYVWLETWRPGLQLQLQRSWLSTMTTVPSVGTPCRLRGNCPVDIFSTRSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 7945 - protein, 545 aa, Homo sapiens
  Payload ID: 1661;
  Gene Symbol: AIRE;
  Gene Name: autoimmune regulator;
  Uniprot ID:  O43918;
  ENSP ID: ENSP00000291582
MATDAALRRLLRLHRTEIAVAVDSAFPLLHALADHDVVPEDKFQETLHLKEKEGCPQAFHALLSWLLTQDSTAILDFWRVLFKDYNLERYGRLQPILDSFPKDVDLSQPRKGRKPPAVPKALVPPPRLPTKRKASEEARAAAPAALTPRGTASPGSQLKAKPPKKPESSAEQQRLPLGNGIQTMSASVQRAVAMSSGDVPGARGAVEGILIQQVFESGGSKKCIQVGGEFYTPSKFEDSGSGKNKARSSSGPKPLVRAKGAQGAAPGGGEARLGQQGSVPAPLALPSDPQLHQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 7946 - protein, 220 aa, Homo sapiens
  Payload ID: 1662;
  Gene Symbol: ATG10;
  Gene Name: autophagy related 10;
  Uniprot ID:  Q9H0Y0;
  ENSP ID: ENSP00000282185
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLDGRPLTLKDIWEGVHECYKMRLLQGPWDTITQQEHPILGQPFFVLHPCKTNEFMTPVLKNSQKINKNVNYITSWLSIVGPVVGLNLPLSYAKATSQDERNVP

SEQ ID NO: 7947 - protein, 125 aa, Homo sapiens
  Payload ID: 1662;
  Gene Symbol: ATG10;
  Gene Name: autophagy related 10;
  Uniprot ID:  Q9H0Y0;
  ENSP ID: ENSP00000347309
MEEDEFIGEKTFQRYCAEFIKHSQQIGDSWEWRPSKDCSDGYMCKIHFQIKNGSVMSHLGASTHGQTCLPMEVKSCSVTQAGVQLRDLSSLQPPPSGFKQFSCLSLPSNWDYRGSPLHLANFLYF

SEQ ID NO: 7948 - protein, 220 aa, Homo sapiens; identical to SEQ ID NO: 7946
  Payload ID: 1662;
  Gene Symbol: ATG10;
  Gene Name: autophagy related 10;
  Uniprot ID:  Q9H0Y0;
  ENSP ID: ENSP00000404938

SEQ ID NO: 7949 - protein, 36 aa, Homo sapiens
  Payload ID: 1662;
  Gene Symbol: ATG10;
  Gene Name: autophagy related 10;
  ENSP ID: ENSP00000422340
MEEDEFIGEKTFQRYCAEFIKHSQQIGDSWEWRPSK

SEQ ID NO: 7950 - protein, 171 aa, Homo sapiens
  Payload ID: 1662;
  Gene Symbol: ATG10;
  Gene Name: autophagy related 10;
  ENSP ID: ENSP00000424236
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLDGRPLTLKDIWEGVHECYKMRLLQGPWDTITQQIFTKRCSEGHISVTKNIIPE

SEQ ID NO: 7951 - protein, 125 aa, Homo sapiens; identical to SEQ ID NO: 7947
  Payload ID: 1662;
  Gene Symbol: ATG10;
  Gene Name: autophagy related 10;
  Uniprot ID:  Q9H0Y0;
  ENSP ID: ENSP00000425182

SEQ ID NO: 7952 - protein, 184 aa, Homo sapiens
  Payload ID: 1662;
  Gene Symbol: ATG10;
  Gene Name: autophagy related 10;
  ENSP ID: ENSP00000425225
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLDGRPLTLKDIWEGVHECYKMRLLQGPWDTITQQEHPILGQPFFVLHPCKTNEFMTPVLKNSQKINK

SEQ ID NO: 7953 - protein, 218 aa, Homo sapiens
  Payload ID: 1663;
  Gene Symbol: ATG101;
  Gene Name: autophagy related 101;
  Uniprot ID:  Q9BSB4;
  ENSP ID: ENSP00000338990
MNCRSEVLEVSVEGRQVEEAMLAVLHTVLLHRSTGKFHYKKEGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTLAL

SEQ ID NO: 7954 - protein, 141 aa, Homo sapiens
  Payload ID: 1663;
  Gene Symbol: ATG101;
  Gene Name: autophagy related 101;
  ENSP ID: ENSP00000449935
MNCRSEVLEVSVEGRQVEEAMLAVLHTVLLHRSTGKFHYKKEGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICR

SEQ ID NO: 7955 - protein, 190 aa, Homo sapiens
  Payload ID: 1663;
  Gene Symbol: ATG101;
  Gene Name: autophagy related 101;
  ENSP ID: ENSP00000450088
MNCRSEVLEVSVEGRQVEEAMLAVLHTVLLHRSTGKFHYKKEGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLY

SEQ ID NO: 7956 - protein, 84 aa, Homo sapiens
  Payload ID: 1663;
  Gene Symbol: ATG101;
  Gene Name: autophagy related 101;
  ENSP ID: ENSP00000454613
MNCRSEVLEVSVEGRQVEEAMLAVLHTVLLHRSTGKFHYKKEGTYSIGTVGTQDVDCDFIDFTYVRVSSEELDRALRKVVGEFK

SEQ ID NO: 7957 - protein, 75 aa, Homo sapiens
  Payload ID: 1664;
  Gene Symbol: ATG12;
  Gene Name: autophagy related 12;
  ENSP ID: ENSP00000368913
MAEEPQSVLQLPTSIAAGGEGLTDVSPETTTPEPPSSAAVSPGTEEPAGDTKKKNDSGLWPGAVAHSCNPSTLVG

SEQ ID NO: 7958 - protein, 56 aa, Homo sapiens
  Payload ID: 1664;
  Gene Symbol: ATG12;
  Gene Name: autophagy related 12;
  ENSP ID: ENSP00000424529
MAEEPQSVLQLPTSIAAGGEGLTDVSPETTTPEPPSSAAVSPGTEEPAGDTKKKSN

SEQ ID NO: 7959 - protein, 140 aa, Homo sapiens
  Payload ID: 1664;
  Gene Symbol: ATG12;
  Gene Name: autophagy related 12;
  Uniprot ID:  O94817;
  ENSP ID: ENSP00000425107
MAEEPQSVLQLPTSIAAGGEGLTDVSPETTTPEPPSSAAVSPGTEEPAGDTKKKIDILLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 7960 - protein, 74 aa, Homo sapiens
  Payload ID: 1664;
  Gene Symbol: ATG12;
  Gene Name: autophagy related 12;
  Uniprot ID:  O94817;
  ENSP ID: ENSP00000425164
MAEEPQSVLQLPTSIAAGGEGLTDVSPETTTPEPPSSAAVSPGTEEPAGDTKKKIYLCESVLCSFPRPRSWNSL

SEQ ID NO: 7961 - protein, 59 aa, Homo sapiens
  Payload ID: 1664;
  Gene Symbol: ATG12;
  Gene Name: autophagy related 12;
  ENSP ID: ENSP00000425277
  MOD_RES (1)..(1): Any amino acid
XEPQSVLQLPTSIAAGGEGLTDVSPETTTPEPPSSAAVSPGTEEPAGDTKKKIGCEFTP

SEQ ID NO: 7962 - protein, 66 aa, Homo sapiens
  Payload ID: 1664;
  Gene Symbol: ATG12;
  Gene Name: autophagy related 12;
  ENSP ID: ENSP00000425948
  MOD_RES (1)..(1): Any amino acid
XSPSKMAEEPQSVLQLPTSIAAGGEGLTDVSPETTTPEPPSSAAVSPGTEEPAGDTKKKIGCEFTP

SEQ ID NO: 7963 - protein, 517 aa, Homo sapiens
  Payload ID: 1665;
  Gene Symbol: ATG13;
  Gene Name: autophagy related 13;
  Uniprot ID:  O75143;
  ENSP ID: ENSP00000352500
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLSSSRLSYQPAALGVGSADLAYPVVFAAGLNATHPHQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 7964 - protein, 198 aa, Homo sapiens
  Payload ID: 1665;
  Gene Symbol: ATG13;
  Gene Name: autophagy related 13;
  ENSP ID: ENSP00000378919
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMST

SEQ ID NO: 7965 - protein, 78 aa, Homo sapiens
  Payload ID: 1665;
  Gene Symbol: ATG13;
  Gene Name: autophagy related 13;
  ENSP ID: ENSP00000431877
PSSSEDTETVSNSSEGRASPHDVLETIFVRKVGAFVNKPINQVTLTSLDIPFAMFAPKNLELEDTDPMVSPPLTTSSQ

SEQ ID NO: 7966 - protein, 517 aa, Homo sapiens; identical to SEQ ID NO: 7963
  Payload ID: 1665;
  Gene Symbol: ATG13;
  Gene Name: autophagy related 13;
  Uniprot ID:  O75143;
  ENSP ID: ENSP00000431974

SEQ ID NO: 7967 - protein, 550 aa, Homo sapiens
  Payload ID: 1665;
  Gene Symbol: ATG13;
  Gene Name: autophagy related 13;
  Uniprot ID:  O75143;
  ENSP ID: ENSP00000432412
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQCVFTVTKAHFQTPTPVVTDTLRVPMAGLAFSHQLSSSRLSYQPAALGVGSADLAYPVVFAAGLNATHPHQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 7968 - protein, 480 aa, Homo sapiens
  Payload ID: 1665;
  Gene Symbol: ATG13;
  Gene Name: autophagy related 13;
  Uniprot ID:  O75143;
  ENSP ID: ENSP00000433543
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 7969 - protein, 480 aa, Homo sapiens; identical to SEQ ID NO: 7968
  Payload ID: 1665;
  Gene Symbol: ATG13;
  Gene Name: autophagy related 13;
  Uniprot ID:  O75143;
  ENSP ID: ENSP00000433756

SEQ ID NO: 7970 - protein, 47 aa, Homo sapiens
  Payload ID: 1665;
  Gene Symbol: ATG13;
  Gene Name: autophagy related 13;
  ENSP ID: ENSP00000434125
  MOD_RES (1)..(1): Any amino acid
XPSVEDSQEVCTTSFSTSPPSQDSLPEKLAVHEKNVREFDAFVETLQ

SEQ ID NO: 7971 - protein, 401 aa, Homo sapiens
  Payload ID: 1665;
  Gene Symbol: ATG13;
  Gene Name: autophagy related 13;
  Uniprot ID:  O75143;
  ENSP ID: ENSP00000434390
MCVEISLKTSEGDSMELEIWCLEMNEKCDKEIKVSYTVYNRLSLLLKSLLAITRVTPAYRLSRKQGHEYVILYRIYFGEVQLSGLGEGFQTVRVGTVGTPVGTITLSCAYRINLAFMSTRQFERTPPIMGIIIDHFVDRPYPSSSPMHPCNYRTAGEDTGVIYPSVEDSQEVCTTSFSTSPPSQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPMDLGTFYREFQNPPQLSSLSIDIGAQSMAEDLDSLPEKLAVHEKNVREFDAFVETLQ

SEQ ID NO: 7972 - protein, 193 aa, Homo sapiens
  Payload ID: 1665;
  Gene Symbol: ATG13;
  Gene Name: autophagy related 13;
  ENSP ID: ENSP00000436174
VFTVTKAHFQTPTPVVTDTLRVPMAGLAFSHQLMVPGKEGGVPLAPNQPVHGTQADQERLATCTPSDRTHCAATPSSSEDTETVSNSSEGRASPHDVLETIFVRKVGAFVNKPINQVTLTSLDIPFAMFAPKNLELEDTDPMVNPPDSPETESPLQGSLHSDGSSGGSSGNTHDDFVMIDFKPAFSKDDILPM

SEQ ID NO: 7973 - protein, 119 aa, Homo sapiens
  Payload ID: 1665;
  Gene Symbol: ATG13;
  Gene Name: autophagy related 13;
  ENSP ID: ENSP00000436931
METDLNSQDRKDLDKFIKFFALKTVQVIVQARLGEKICTRSSSSPTGSDWFNLAIKDIPEVTHEAKKALAGQLPAVGRSMCVEISLKTSEGDSMELEIWCLEMNEKCDKEIKVSYTVYN

SEQ ID NO: 7974 - protein, 42 aa, Homo sapiens
  Payload ID: 1665;
  Gene Symbol: ATG13;
  Gene Name: autophagy related 13;
  ENSP ID: ENSP00000437191
  MOD_RES (1)..(1): Any amino acid
XKPINQVTLTSLDIPFAMFAPKNLELEDTDPMVSPPLTTSSQ

SEQ ID NO: 7975 - protein, 56 aa, Homo sapiens
  Payload ID: 1665;
  Gene Symbol: ATG13;
  Gene Name: autophagy related 13;
  ENSP ID: ENSP00000462167
METDLNSQDRKDLDKFIKFFALKTVQVIVQARLGEKICTRSSSSPTGSDWFNLAIK

SEQ ID NO: 7976 - protein, 33 aa, Homo sapiens
  Payload ID: 1665;
  Gene Symbol: ATG13;
  Gene Name: autophagy related 13;
  ENSP ID: ENSP00000462644
METDLNSQDRKDLDKFIKFFALKTVQVIVQARL

SEQ ID NO: 7977 - protein, 13 aa, Homo sapiens
  Payload ID: 1665;
  Gene Symbol: ATG13;
  Gene Name: autophagy related 13;
  ENSP ID: ENSP00000463550
METDLNSQDRKDL

SEQ ID NO: 7978 - protein, 32 aa, Homo sapiens
  Payload ID: 1665;
  Gene Symbol: ATG13;
  Gene Name: autophagy related 13;
  ENSP ID: ENSP00000463808
METDLNSQDRKDLDKFIKFFALKTVQVIVQAR

SEQ ID NO: 7979 - protein, 27 aa, Homo sapiens
  Payload ID: 1665;
  Gene Symbol: ATG13;
  Gene Name: autophagy related 13;
  ENSP ID: ENSP00000463998
METDLNSQDRKDLDKFIKFFALKTVQV

SEQ ID NO: 7980 - protein, 38 aa, Homo sapiens
  Payload ID: 1665;
  Gene Symbol: ATG13;
  Gene Name: autophagy related 13;
  ENSP ID: ENSP00000464091
METDLNSQDRKDLDKFIKFFALKTVQVIVQARLGEKIC

SEQ ID NO: 7981 - protein, 50 aa, Homo sapiens
  Payload ID: 1665;
  Gene Symbol: ATG13;
  Gene Name: autophagy related 13;
  ENSP ID: ENSP00000464274
METDLNSQDRKDLDKFIKFFALKTVQVIVQARLGEKICTRSSSSPTGSDW

SEQ ID NO: 7982 - protein, 492 aa, Homo sapiens
  Payload ID: 1666;
  Gene Symbol: ATG14;
  Gene Name: autophagy related 14;
  Uniprot ID:  Q6ZNE5;
  ENSP ID: ENSP00000247178
MASPSGKGARALEAPGCGPRPLARDLVDSVDDAEGLYVAVERCPLCNTTRRRLTCAKCVQSGDFVYFDGRDRERFIDKKERLSRLKSKQEEFQKEVLKAMEGKWITDQLRWKIMSCKMRIEQLKQTICKGNEEMEKNSEGLLKTKEKNQKLYSRAQRHQEKKEKIQRHNRKLGDLVEKKTIDLRSHYERLANLRRSHILELTSVIFPIEEVKTGVRDPADVSSESDSAMTSSTVSKLAEARRTTYLSGRWVCDDHNGDTSISITGPWISLPNNGDYSAYYSWVEEKKTTQGPDMEQSNPAYTISAALCYATQLVNILSHILDVNLPKKLCNSEFCGENLSKQKFTRAVKKLNANILYLCFSQHVNLDQLQPLHTLRNLMYLVSPSSEHLGRSGPFEVRADLEESMEFVDPGVAGESDESGDERVSDEETDLGTDWENLPSPRFCDIPSQSVEVSQSQSTQASPPIASSSAGGMISSAAASVTSWFKAYTGHR

SEQ ID NO: 7983 - protein, 444 aa, Homo sapiens
  Payload ID: 1667;
  Gene Symbol: ATG16L1;
  Gene Name: autophagy related 16-like 1;
  Uniprot ID:  Q676U5;
  ENSP ID: ENSP00000318259
MSSGLRAADFPRWKRHISEQLRRRDRLQRQAFEEIILQYNKLLEKSDLHSVLAQKLQAEKHDVPNRHEIRRRQARLQKELAEAAKEPLPVEQDDDIEVIVDETSDHTEETSPVRAISRAATRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 7984 - protein, 428 aa, Homo sapiens
  Payload ID: 1667;
  Gene Symbol: ATG16L1;
  Gene Name: autophagy related 16-like 1;
  Uniprot ID:  Q676U5;
  ENSP ID: ENSP00000362625
MSSGLRAADFPRWKRHISEQLRRRDRLQRQAFEEIILQYNKLLEKSDLHSVLAQKLQAEKHDVPNRHEIRRRQARLQKELAEAAKEPLPVEQDDDIEVIVDETSDHTEETSPVRAISRAATKRLSQPAGGLLDSITNIFGRRSVSSFPVPQDNVDTHPGSGKEVRVPATALCVFDAHDGEVNAVQFSPGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 7985 - protein, 607 aa, Homo sapiens
  Payload ID: 1667;
  Gene Symbol: ATG16L1;
  Gene Name: autophagy related 16-like 1;
  Uniprot ID:  Q676U5;
  ENSP ID: ENSP00000375872
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATKRLSQPAGGLLDSITNIFGRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 7986 - protein, 624 aa, Homo sapiens
  Payload ID: 1667;
  Gene Symbol: ATG16L1;
  Gene Name: autophagy related 16-like 1;
  ENSP ID: ENSP00000375873
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATKRLSQPAGGLLDSITNIFGLSESPLLGHHSSSDAARRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 7987 - protein, 588 aa, Homo sapiens
  Payload ID: 1667;
  Gene Symbol: ATG16L1;
  Gene Name: autophagy related 16-like 1;
  Uniprot ID:  Q676U5;
  ENSP ID: ENSP00000375875
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 7988 - protein, 38 aa, Homo sapiens
  Payload ID: 1667;
  Gene Symbol: ATG16L1;
  Gene Name: autophagy related 16-like 1;
  ENSP ID: ENSP00000375876
MSSGLRAADFPRWKRHISEQLRRRDRLQRQAFEEIILQ

SEQ ID NO: 7989 - protein, 55 aa, Homo sapiens
  Payload ID: 1667;
  Gene Symbol: ATG16L1;
  Gene Name: autophagy related 16-like 1;
  ENSP ID: ENSP00000397512
MAQLRIKHQEELTELHKKRGELAQLVIDLNNQMQRKDREMQMNEAKIAECLQTIS

SEQ ID NO: 7990 - protein, 164 aa, Homo sapiens
  Payload ID: 1667;
  Gene Symbol: ATG16L1;
  Gene Name: autophagy related 16-like 1;
  ENSP ID: ENSP00000398773
MSSGLRAADFPRWKRHISEQLRRRDRLQRQAFEEIILQYNKLLEKSDLHSVLAQKLQAEKHDVPNRHEIRRRQARLQKELAEAAKEPLPVEQDDDIEVIVDETSDHTEETSPVRAISRAATRRSVSSFPVPQDNVDTHPGSGKEVRVPATALCVFDAHDGEVNA

SEQ ID NO: 7991 - protein, 177 aa, Homo sapiens
  Payload ID: 1667;
  Gene Symbol: ATG16L1;
  Gene Name: autophagy related 16-like 1;
  ENSP ID: ENSP00000409215
MSSGLRAADFPRWKRHISEQLRRRDRLQRQAFEEIILQYNKLLEKSDLHSVLAQKLQAEKHDVPNRHEIRRRQARLQKELAEAAKEPLPVEQDDDIEVIVDETSDHTEETSPVRAISRAATKRLSQPAGGLLDSITNIFGLSESPLLGHHSSSDAARRRSVSSFPVPQDNVDTHPGS

SEQ ID NO: 7992 - protein, 187 aa, Homo sapiens
  Payload ID: 1667;
  Gene Symbol: ATG16L1;
  Gene Name: autophagy related 16-like 1;
  ENSP ID: ENSP00000412046
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKRRQARLQKELAEAAKEPLPVEQDDDIEVIVDETSDHTEETSPVRAISRAATKRLSQP

SEQ ID NO: 7993 - protein, 38 aa, Homo sapiens; identical to SEQ ID NO: 7988
  Payload ID: 1667;
  Gene Symbol: ATG16L1;
  Gene Name: autophagy related 16-like 1;
  ENSP ID: ENSP00000485758

SEQ ID NO: 7994 - protein, 187 aa, Homo sapiens; identical to SEQ ID NO: 7992
  Payload ID: 1667;
  Gene Symbol: ATG16L1;
  Gene Name: autophagy related 16-like 1;
  ENSP ID: ENSP00000486453

SEQ ID NO: 7995 - protein, 624 aa, Homo sapiens; identical to SEQ ID NO: 7986
  Payload ID: 1667;
  Gene Symbol: ATG16L1;
  Gene Name: autophagy related 16-like 1;
  ENSP ID: ENSP00000486603

SEQ ID NO: 7996 - protein, 177 aa, Homo sapiens; identical to SEQ ID NO: 7991
  Payload ID: 1667;
  Gene Symbol: ATG16L1;
  Gene Name: autophagy related 16-like 1;
  ENSP ID: ENSP00000486688

SEQ ID NO: 7997 - protein, 55 aa, Homo sapiens; identical to SEQ ID NO: 7989
  Payload ID: 1667;
  Gene Symbol: ATG16L1;
  Gene Name: autophagy related 16-like 1;
  ENSP ID: ENSP00000487252

SEQ ID NO: 7998 - protein, 444 aa, Homo sapiens; identical to SEQ ID NO: 7983
  Payload ID: 1667;
  Gene Symbol: ATG16L1;
  Gene Name: autophagy related 16-like 1;
  Uniprot ID:  Q676U5;
  ENSP ID: ENSP00000487298

SEQ ID NO: 7999 - protein, 164 aa, Homo sapiens; identical to SEQ ID NO: 7990
  Payload ID: 1667;
  Gene Symbol: ATG16L1;
  Gene Name: autophagy related 16-like 1;
  ENSP ID: ENSP00000487407

SEQ ID NO: 8000 - protein, 588 aa, Homo sapiens; identical to SEQ ID NO: 7987
  Payload ID: 1667;
  Gene Symbol: ATG16L1;
  Gene Name: autophagy related 16-like 1;
  Uniprot ID:  Q676U5;
  ENSP ID: ENSP00000487446

SEQ ID NO: 8001 - protein, 428 aa, Homo sapiens; identical to SEQ ID NO: 7984
  Payload ID: 1667;
  Gene Symbol: ATG16L1;
  Gene Name: autophagy related 16-like 1;
  Uniprot ID:  Q676U5;
  ENSP ID: ENSP00000487455

SEQ ID NO: 8002 - protein, 607 aa, Homo sapiens; identical to SEQ ID NO: 7985
  Payload ID: 1667;
  Gene Symbol: ATG16L1;
  Gene Name: autophagy related 16-like 1;
  Uniprot ID:  Q676U5;
  ENSP ID: ENSP00000487542

SEQ ID NO: 8003 - protein, 619 aa, Homo sapiens
  Payload ID: 1668;
  Gene Symbol: ATG16L2;
  Gene Name: autophagy related 16-like 2;
  Uniprot ID:  Q8NAA4;
  ENSP ID: ENSP00000326340
MAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGEMAYQVVEKGAALGTLESELQQRQSRLAALEARVAQLREARAQQAQQVEEWRAQNAVQRAAYEALRAHVGLREAALRRLQEEARDLLERLVQRKARAAAERNLRNERRERAKQARVSQELKKAAKRTVSISEGPDTLGDGMRERRETLALAPEPEPLEKEACEKWKRPFRSASATSLTLSHCVDVVKGLLDFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 8004 - protein, 121 aa, Homo sapiens
  Payload ID: 1668;
  Gene Symbol: ATG16L2;
  Gene Name: autophagy related 16-like 2;
  ENSP ID: ENSP00000400705
MAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGELAFQEGGGQVSSRLP

SEQ ID NO: 8005 - protein, 450 aa, Homo sapiens
  Payload ID: 1668;
  Gene Symbol: ATG16L2;
  Gene Name: autophagy related 16-like 2;
  ENSP ID: ENSP00000437412
AGRSRASPVSGREGGSSRPLEEGTGSSPACVRGAAPGSQDAFYPTRAKQARVSQELKKAAKRTVSISEGPDTLGDGMRERRETLALAPEPEPLEKEACEKWKRPFRSASATSLTLSHCVDVVKGLLDFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 8006 - protein, 74 aa, Homo sapiens
  Payload ID: 1668;
  Gene Symbol: ATG16L2;
  Gene Name: autophagy related 16-like 2;
  ENSP ID: ENSP00000437932
  MOD_RES (1)..(1): Any amino acid
XAKQARVSQELKKAAKRTVSISEGPDTLGDGMRERRETLALAPEPEPLEKEACEKWKRPFSLSLQVPGVQALGQ

SEQ ID NO: 8007 - protein, 321 aa, Homo sapiens
  Payload ID: 1668;
  Gene Symbol: ATG16L2;
  Gene Name: autophagy related 16-like 2;
  ENSP ID: ENSP00000438474
  MOD_RES (1)..(1): Any amino acid
XRKGPAPAGRSRASPVSGREGGSSRPLEEGTGSSPACVRGAAPGSQDAFYPTRAKQARVSQELKKAAKRTVSISEGPDTLGDGMRERRETLALAPEPEPLEKEACEKWKRPFRSASATSLTLSHCVDVVKGLLDFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQ

SEQ ID NO: 8008 - protein, 98 aa, Homo sapiens
  Payload ID: 1668;
  Gene Symbol: ATG16L2;
  Gene Name: autophagy related 16-like 2;
  ENSP ID: ENSP00000441132
  MOD_RES (1)..(1): Any amino acid
XQARVSQELKKAAKRTVSISEGPDTLGDGMRERRETLALAPEPEPLEKEACEKWKRPFRGPHCTQVIPVQGRVTSLSLSHDQLHLLSCSRDNTLKVID

SEQ ID NO: 8009 - protein, 164 aa, Homo sapiens
  Payload ID: 1668;
  Gene Symbol: ATG16L2;
  Gene Name: autophagy related 16-like 2;
  ENSP ID: ENSP00000441189
MAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGEGAPLHPGHPCAGPGHLPEPQPRPTAPAQLFPRQHTQGHRPACQQHPPGVQGRWLQVWF

SEQ ID NO: 8010 - protein, 397 aa, Homo sapiens
  Payload ID: 1668;
  Gene Symbol: ATG16L2;
  Gene Name: autophagy related 16-like 2;
  ENSP ID: ENSP00000441747
  MOD_RES (1)..(1): Any amino acid
XAAPGSQDAFYPTRAKQARVSQELKKAAKRTVSISEGPDTLGDGMRERRETLALAPEPEPLEKEACEKWKRPFSFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSPDRSYALAGSCDGALYIWDVDTGKLESRLQGPHCAAVNAVAWCYSGSHMVSVDQGRKVVLWQ

SEQ ID NO: 8011 - protein, 416 aa, Homo sapiens
  Payload ID: 1668;
  Gene Symbol: ATG16L2;
  Gene Name: autophagy related 16-like 2;
  ENSP ID: ENSP00000441989
AGRSRASPVSGREGGSSRPLEEGTGSSPACVRGAAPGSQDAFYPTRAKQARVSQELKKAAKRTVSISEGPDTLGDGMRERRETLALAPEPEPLEKEACEKWKRPFRSASATSLTLSHCVDVVKGLLDFKKRRGHSIGGAPEQRYQIIPVCVAARLPTRAQDVLDAHLSEVNAVRFGPNSSLLATGGADRLIHLWNVVGSRLEANQTLEGAGGSITSVDFDPSGYQVLAATYNQAAQLWKVGEAQSKETLSGHKDKVTAAKFKLTRHQAVTGSRDRTVKEWDLGRAYCSRTINVLSYCNDVVCGDHIIISGHNDQKIRFWDSRGPHCTQVIPVQGRVTSLSLSHDQLHLLSCSRDNTLKVIDLRVSNIRQVFRADGFKCGSDWTKAVFSAAVNAVAWCYSGSHMVSVDQGRKVVLWQ

SEQ ID NO: 8012 - protein, 106 aa, Homo sapiens
  Payload ID: 1668;
  Gene Symbol: ATG16L2;
  Gene Name: autophagy related 16-like 2;
  ENSP ID: ENSP00000442635
MAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGE

SEQ ID NO: 8013 - protein, 98 aa, Homo sapiens
  Payload ID: 1668;
  Gene Symbol: ATG16L2;
  Gene Name: autophagy related 16-like 2;
  ENSP ID: ENSP00000442931
LVQRKARAAAERNLRNERRERAKQARVSQELKKAAKRTVSISEGPDTLGDGMRERRETLALAPEPEPLEKEACEKWKRPFRPRLSFPGTFVGLPQPPP

SEQ ID NO: 8014 - protein, 117 aa, Homo sapiens
  Payload ID: 1668;
  Gene Symbol: ATG16L2;
  Gene Name: autophagy related 16-like 2;
  ENSP ID: ENSP00000443569
  MOD_RES (1)..(1): Any amino acid
XESAAMAGPGVPGAPAARWKRHIVRQLRLRDRTQKALFLELVPAYNHLLEKAELLDKFSKKLQPEPNSVTPTTHQGPWEESELDSDQVPSLVALRVKWQEEEEGLRLVCGEVSWEGV

SEQ ID NO: 8015 - protein, 1938 aa, Homo sapiens
  Payload ID: 1669;
  Gene Symbol: ATG2A;
  Gene Name: autophagy related 2A;
  Uniprot ID:  Q2TAZ0;
  ENSP ID: ENSP00000366475
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPEPDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLANCFDLTPDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRAAVDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 8016 - protein, 331 aa, Homo sapiens
  Payload ID: 1669;
  Gene Symbol: ATG2A;
  Gene Name: autophagy related 2A;
  Uniprot ID:  Q2TAZ0;
  ENSP ID: ENSP00000410522
MAVAMVKLCERAGLPLLAAPLLRSLLPRAPQPGPAQPRSVQGQRCPARHPPGNLVCERGAGVNGVTAGAGGRLRGLHRGGRALGCSAHRPLHSARVRPPAHLAAPPGSSARGCRLTELGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 8017 - protein, 1742 aa, Homo sapiens
  Payload ID: 1669;
  Gene Symbol: ATG2A;
  Gene Name: autophagy related 2A;
  ENSP ID: ENSP00000413716
  MOD_RES (1)..(1): Any amino acid
XYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPEPDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLANCFDLTPDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRAAVDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKVQLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 8018 - protein, 2078 aa, Homo sapiens
  Payload ID: 1670;
  Gene Symbol: ATG2B;
  Gene Name: autophagy related 2B;
  Uniprot ID:  Q96BY7;
  ENSP ID: ENSP00000353010
MPWPFSESIKKRACRYLLQRYLGHFLQEKLSLEQLSLDLYQGTGSLAQVPLDKWCLNEILESADAPLEVTEGFIQSISLSVPWGSLLQDNCALEVRGLEMVFRPRPRPATGSEPMYWSSFMTSSMQLAKECLSQKLTDEQGEGSQPFEGLEKFAETIETVLRRVKVTFIDTVLRIEHVPENSKTGTALEIRIERTVYCDETADESSGINVHQPTAFAHKLLQLSGVSLFWDEFSASAKSSPVCSTAPVETEPKLSPSWNPKIIYEPHPQLTRNLPEIAPSDPVQIGRLIGRLELSLTLKQNEVLPGAKLDVDGQIDSIHLLLSPRQVHLLLDMLAAIAGPENSSKIGLANKDRKNRPMQQEDEYRIQMELNRYYLRKDSLSVGVSSEQSFYETETARTPSSREEEVFFSMADMDMSHSLSSLPPLGDPPNMDLELSLTSTYTNTPAGSPLSATVLQPTWGEFLDHHKEQPVRGSTFPSNLVHPTPLQKTSLPSRSVSVDESRPELIFRLAVGTFSISVLHIDPLSPPETSQNLNPLTPMAVAFFTCIEKIDPARFSTEDFKSFRAVFAEACSHDHLRFIGTGIKVSYEQRQRSASRYFSTDMSIGQMEFLECLFPTDFHSVPPHYTELLTFHSKEETGSHSPVCLQLHYKHSENRGPQGNQARLSSVPHKAELQIKLNPVCCELDISIVDRLNSLLQPQKLATVEMMASHMYTSYNKHISLHKAFTEVFLDDSHSPANCRISVQVATPALNLSVRFPIPDLRSDQERGPWFKKSLQKEILYLAFTDLEFKTEFIGGSTPEQIKLELTFRELIGSFQEEKGDPSIKFFHVSSGVDGDTTSSDDFDWPRIVLKINPPAMHSILERIAAEEEEENDGHYQEEEEGGAHSLKDVCDLRRPAPSPFSSRRVMFENEQMVMPGDPVEMTEFQDKAISNSHYVLELTLPNIYVTLPNKSFYEKLYNRIFNDLLLWEPTAPSPVETFENISYGIGLSVASQLINTFNKDSFSAFKSAVHYDEESGSEEETLQYFSTVDPNYRSRRKKKLDSQNKNSQSFLSVLLNINHGLIAVFTDVKQDNGDLLENKHGEFWLEFNSGSLFCVTKYEGFDDKHYICLHSSSFSLYHKGIVNGVILPTETRLPSSTRPHWLEPTIYSSEEDGLSKTSSDGVGGDSLNMLSVAVKILSDKSESNTKEFLIAVGLKGATLQHRMLPSGLSWHEQILYFLNIADEPVLGYNPPTSFTTFHVHLWSCALDYRPLYLPIRSLLTVETFSVSSSVALDKSSSTLRIILDEAALHLSDKCNTVTINLSRDYVRVMDMGLLELTITAVKSDSDGEQTEPRFELHCSSDVVHIRTCSDSCAALMNLIQYIASYGDLQTPNKADMKPGAFQRRSKVDSSGRSSSRGPVLPEADQQMLRDLMSDAMEEIDMQQGTSSVKPQANGVLDEKSQIQEPCCSDLFLFPDESGNVSQESGPTYASFSHHFISDAMTGVPTENDDFCILFAPKAAMQEKEEEPVIKIMVDDAIVIRDNYFSLPVNKTDTSKAPLHFPIPVIRYVVKEVSLVWHLYGGKDFGIVPPTSPAKSYISPHSSPSHTPTRHGRNTVCGGKGRNHDFLMEIQLSKVKFQHEVYPPCKPDCDSSLSEHPVSRQVFIVQDLEIRDRLATSQMNKFLYLYCSKEMPRKAHSNMLTVKALHVCPESGRSPQECCLRVSLMPLRLNIDQDALFFLKDFFTSLSAEVELQMTPDPEVKKSPGADVTCSLPRHLSTSKEPNLVISFSGPKQPSQNDSANSVEVVNGMEEKNFSAEEASFRDQPVFFREFRFTSEVPIRLDYHGKHVSMDQGTLAGILIGLAQLNCSELKLKRLSYRHGLLGVDKLFSYAITEWLNDIKKNQLPGILGGVGPMHSLVQLVQGLKDLVWLPIEQYRKDGRIVRGFQRGAASFGTSTAMAALELTNRMVQTIQAAAETAYDMVSPGTLSIEPKKTKRFPHHRLAHQPVDLREGVAKAYSVVKEGITDTAQTIYETAAREHESRGVTGAVGEVLRQIPPAVVKPLIVATEATSNVLGGMRNQIRPDVRQDESQKWRHGDD

SEQ ID NO: 8019 - protein, 314 aa, Homo sapiens
  Payload ID: 1671;
  Gene Symbol: ATG3;
  Gene Name: autophagy related 3;
  Uniprot ID:  Q9NT62;
  ENSP ID: ENSP00000283290
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 8020 - protein, 311 aa, Homo sapiens
  Payload ID: 1671;
  Gene Symbol: ATG3;
  Gene Name: autophagy related 3;
  Uniprot ID:  Q9NT62;
  ENSP ID: ENSP00000385943
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYPSLYVRLVAKWLLTIFFLRNLV

SEQ ID NO: 8021 - protein, 74 aa, Homo sapiens
  Payload ID: 1671;
  Gene Symbol: ATG3;
  Gene Name: autophagy related 3;
  ENSP ID: ENSP00000420259
MQNVINTVKGKALEVAEYLTPVLKESKFKETGVITPEEFVAAGDHLVHHCPTWQWATGEELKVKAYLPTDGIFR

SEQ ID NO: 8022 - protein, 83 aa, Homo sapiens
  Payload ID: 1671;
  Gene Symbol: ATG3;
  Gene Name: autophagy related 3;
  ENSP ID: ENSP00000420378
MEYSDELEAIIEEDDGDGGWVDTYHNTGITGITEAVKEITLENKDNIRLQDCSALCEEEEDEDEGEAADMEEYEESGLLETDE

SEQ ID NO: 8023 - protein, 336 aa, Homo sapiens
  Payload ID: 1672;
  Gene Symbol: ATG4A;
  Gene Name: autophagy related 4A, cysteine peptidase;
  Uniprot ID:  Q8WYN0;
  ENSP ID: ENSP00000298131
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 8024 - protein, 231 aa, Homo sapiens
  Payload ID: 1672;
  Gene Symbol: ATG4A;
  Gene Name: autophagy related 4A, cysteine peptidase;
  ENSP ID: ENSP00000341833
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMEKMCRVLPLSADTAGDRPPDSLTASNQSKGTSAYCSAWKPLLLIVPLRLGINQINPVYVDAFKVTSSSSWTLIQPRPLLTLKRMERLMTRLSIACSPHSE

SEQ ID NO: 8025 - protein, 398 aa, Homo sapiens
  Payload ID: 1672;
  Gene Symbol: ATG4A;
  Gene Name: autophagy related 4A, cysteine peptidase;
  Uniprot ID:  Q8WYN0;
  ENSP ID: ENSP00000361306
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 8026 - protein, 47 aa, Homo sapiens
  Payload ID: 1672;
  Gene Symbol: ATG4A;
  Gene Name: autophagy related 4A, cysteine peptidase;
  ENSP ID: ENSP00000361320
MESVLSKYEDQITIFTDYLEEYPDTDELVWILGKQHLLKTDWERKTF

SEQ ID NO: 8027 - protein, 312 aa, Homo sapiens
  Payload ID: 1672;
  Gene Symbol: ATG4A;
  Gene Name: autophagy related 4A, cysteine peptidase;
  ENSP ID: ENSP00000378354
  MOD_RES (1)..(1): Any amino acid
XLSKYEDQITIFTDYLEEYPDTDELVWILGKQHLLKTGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQK

SEQ ID NO: 8028 - protein, 202 aa, Homo sapiens
  Payload ID: 1672;
  Gene Symbol: ATG4A;
  Gene Name: autophagy related 4A, cysteine peptidase;
  ENSP ID: ENSP00000416218
MLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLD

SEQ ID NO: 8029 - protein, 76 aa, Homo sapiens
  Payload ID: 1673;
  Gene Symbol: ATG4B;
  Gene Name: autophagy related 4B, cysteine peptidase;
  ENSP ID: ENSP00000344960
  MOD_RES (1)..(1): Any amino acid
XATLTYDTLRFAEFEDFPETSEPVWILGRKYSIFTEKDEILSDVASRLWFTYRKNFPAIGGCRDISLSSKCGPWRY

SEQ ID NO: 8030 - protein, 219 aa, Homo sapiens
  Payload ID: 1673;
  Gene Symbol: ATG4B;
  Gene Name: autophagy related 4B, cysteine peptidase;
  ENSP ID: ENSP00000383582
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIGRLCRTSVPCAGATAFPADSDRHCNGFPAGAEVTNRPSPWRPLVLLIPLRLGLTDINEAYVETLKHCFMMPQSLGVIGGKPNSAHYFIGYV

SEQ ID NO: 8031 - protein, 88 aa, Homo sapiens
  Payload ID: 1673;
  Gene Symbol: ATG4B;
  Gene Name: autophagy related 4B, cysteine peptidase;
  ENSP ID: ENSP00000383583
MDAATLTYDTLRFAEFEDFPETSEPVWILGRKYSIFTEKDEILSDVASRLWFTYRKNFPAIAIHHCCIPWSWKEMGTGSQPCLSPAEN

SEQ ID NO: 8032 - protein, 380 aa, Homo sapiens
  Payload ID: 1673;
  Gene Symbol: ATG4B;
  Gene Name: autophagy related 4B, cysteine peptidase;
  Uniprot ID:  Q9Y4P1;
  ENSP ID: ENSP00000383964
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLGESCQVQILLM

SEQ ID NO: 8033 - protein, 393 aa, Homo sapiens
  Payload ID: 1673;
  Gene Symbol: ATG4B;
  Gene Name: autophagy related 4B, cysteine peptidase;
  Uniprot ID:  Q9Y4P1;
  ENSP ID: ENSP00000384259
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLDSSDVERLERFFDSEDEDFEILSL

SEQ ID NO: 8034 - protein, 331 aa, Homo sapiens
  Payload ID: 1673;
  Gene Symbol: ATG4B;
  Gene Name: autophagy related 4B, cysteine peptidase;
  Uniprot ID:  Q9Y4P1;
  ENSP ID: ENSP00000384661
MLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLGESCQVQVGSLGDSSDVERLERFFDSEDEDFEILSL

SEQ ID NO: 8035 - protein, 88 aa, Homo sapiens; identical to SEQ ID NO: 8031
  Payload ID: 1673;
  Gene Symbol: ATG4B;
  Gene Name: autophagy related 4B, cysteine peptidase;
  ENSP ID: ENSP00000390597

SEQ ID NO: 8036 - protein, 66 aa, Homo sapiens
  Payload ID: 1673;
  Gene Symbol: ATG4B;
  Gene Name: autophagy related 4B, cysteine peptidase;
  ENSP ID: ENSP00000400050
MLRCGQMIFAQALVCRHLGRDWRWTQRKRQPDSYFSVLNAFIDRKDSYYSIHQIAQMGVGEGKSIG

SEQ ID NO: 8037 - protein, 193 aa, Homo sapiens
  Payload ID: 1673;
  Gene Symbol: ATG4B;
  Gene Name: autophagy related 4B, cysteine peptidase;
  ENSP ID: ENSP00000404783
TFAQVCLVSESMSPFLGRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQP

SEQ ID NO: 8038 - protein, 105 aa, Homo sapiens
  Payload ID: 1673;
  Gene Symbol: ATG4B;
  Gene Name: autophagy related 4B, cysteine peptidase;
  ENSP ID: ENSP00000407389
MLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEI

SEQ ID NO: 8039 - protein, 266 aa, Homo sapiens
  Payload ID: 1673;
  Gene Symbol: ATG4B;
  Gene Name: autophagy related 4B, cysteine peptidase;
  ENSP ID: ENSP00000409895
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEISKWLRVSMDKKVEITGNIHTSSPESPREPRRVLSVAPCRAGAPWGLCAKPDARWPRSPIPAVIPREESPGCLEAATWYLTSCFVSWL

SEQ ID NO: 8040 - protein, 147 aa, Homo sapiens
  Payload ID: 1673;
  Gene Symbol: ATG4B;
  Gene Name: autophagy related 4B, cysteine peptidase;
  ENSP ID: ENSP00000410526
MLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRP

SEQ ID NO: 8041 - protein, 88 aa, Homo sapiens; identical to SEQ ID NO: 8031
  Payload ID: 1673;
  Gene Symbol: ATG4B;
  Gene Name: autophagy related 4B, cysteine peptidase;
  ENSP ID: ENSP00000487133

SEQ ID NO: 8042 - protein, 458 aa, Homo sapiens
  Payload ID: 1674;
  Gene Symbol: ATG4C;
  Gene Name: autophagy related 4C, cysteine peptidase;
  Uniprot ID:  Q96DT6;
  ENSP ID: ENSP00000322159
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLETFHCPSPKKMSFRKMDPSCTIGFYCRNVQDFKRASEEITKMLKFSSKEKYPLFTFVNGHSRDYDFTSTTTNEEDLFSEDEKKQLKRFSTEEFVLL

SEQ ID NO: 8043 - protein, 189 aa, Homo sapiens
  Payload ID: 1674;
  Gene Symbol: ATG4C;
  Gene Name: autophagy related 4C, cysteine peptidase;
  ENSP ID: ENSP00000360159
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDH

SEQ ID NO: 8044 - protein, 458 aa, Homo sapiens; identical to SEQ ID NO: 8042
  Payload ID: 1674;
  Gene Symbol: ATG4C;
  Gene Name: autophagy related 4C, cysteine peptidase;
  Uniprot ID:  Q96DT6;
  ENSP ID: ENSP00000360161

SEQ ID NO: 8045 - protein, 110 aa, Homo sapiens
  Payload ID: 1674;
  Gene Symbol: ATG4C;
  Gene Name: autophagy related 4C, cysteine peptidase;
  ENSP ID: ENSP00000391820
  MOD_RES (1)..(1): Any amino acid
XIYVAQDCTVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLEVIL

SEQ ID NO: 8046 - protein, 151 aa, Homo sapiens
  Payload ID: 1674;
  Gene Symbol: ATG4C;
  Gene Name: autophagy related 4C, cysteine peptidase;
  ENSP ID: ENSP00000396614
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTS

SEQ ID NO: 8047 - protein, 474 aa, Homo sapiens
  Payload ID: 1675;
  Gene Symbol: ATG4D;
  Gene Name: autophagy related 4D, cysteine peptidase;
  Uniprot ID:  Q86TL0;
  ENSP ID: ENSP00000311318
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWYGPSLVAHILRKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 8048 - protein, 177 aa, Homo sapiens
  Payload ID: 1675;
  Gene Symbol: ATG4D;
  Gene Name: autophagy related 4D, cysteine peptidase;
  ENSP ID: ENSP00000465089
  MOD_RES (1)..(1): Any amino acid
XNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRVYKADVARLVARPDPTAEWKSVVILVPVRLGGETLNPVYVPCVKELLRCELCLGIMGGKPRHSLYFIGYQGRPTPSSLLPPPTAP

SEQ ID NO: 8049 - protein, 120 aa, Homo sapiens
  Payload ID: 1675;
  Gene Symbol: ATG4D;
  Gene Name: autophagy related 4D, cysteine peptidase;
  ENSP ID: ENSP00000465716
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRL

SEQ ID NO: 8050 - protein, 67 aa, Homo sapiens
  Payload ID: 1675;
  Gene Symbol: ATG4D;
  Gene Name: autophagy related 4D, cysteine peptidase;
  ENSP ID: ENSP00000466439
RRDFPPLPGGCLTSDCGWGCMLRSGQMMLAQGLLLHFLPRGTPALRAVPGHHGWETATLTVLHWLPR

SEQ ID NO: 8051 - protein, 177 aa, Homo sapiens
  Payload ID: 1675;
  Gene Symbol: ATG4D;
  Gene Name: autophagy related 4D, cysteine peptidase;
  ENSP ID: ENSP00000466759
VKELLRCELCLGIMGGKPRHSLYFIGYQGRPTPSSLLPPPTAPPLTPAPPADDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 8052 - protein, 209 aa, Homo sapiens
  Payload ID: 1675;
  Gene Symbol: ATG4D;
  Gene Name: autophagy related 4D, cysteine peptidase;
  ENSP ID: ENSP00000467223
FKAKFLTAWNNVKYGWVVKSRTSFSKISSIHLCGRRYRFEGEGELVVGTRAGGGLSTPAGVSLVAADRPALVGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKA

SEQ ID NO: 8053 - protein, 228 aa, Homo sapiens
  Payload ID: 1675;
  Gene Symbol: ATG4D;
  Gene Name: autophagy related 4D, cysteine peptidase;
  ENSP ID: ENSP00000467407
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRGKPWRAAPTSPAWWCTFLRTAQCTRRMWHAWWPGQTPQPSGSLWSSWCPCDWVARLSTPCMCPA

SEQ ID NO: 8054 - protein, 99 aa, Homo sapiens
  Payload ID: 1675;
  Gene Symbol: ATG4D;
  Gene Name: autophagy related 4D, cysteine peptidase;
  ENSP ID: ENSP00000467694
GKPRHSLYFIGYQDDFLLYLDPHYCQPTVDVSQADFPLEVLSSSSATERYPMFTLAEGHAQDHSLDDLCSQLAQPTLRLPRTGRLLRAKRPSSEDFVFL

SEQ ID NO: 8055 - protein, 160 aa, Homo sapiens
  Payload ID: 1675;
  Gene Symbol: ATG4D;
  Gene Name: autophagy related 4D, cysteine peptidase;
  ENSP ID: ENSP00000467906
MNSVSPAAAQYRSSSPEDARRRPEARRPRGPRGPDPNGLGPSGASGPALGSPGAGPSEPDEVDKFKAKFLTAWNNVKYDGGMEALLLSCKCFISLGAAPTSPQVGWLKAGPALARSPASTSVAAATVSRARVTYSVSSGTLCPACGSHTAGTSRPFLGAA

SEQ ID NO: 8056 - protein, 334 aa, Homo sapiens
  Payload ID: 1675;
  Gene Symbol: ATG4D;
  Gene Name: autophagy related 4D, cysteine peptidase;
  ENSP ID: ENSP00000468290
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKESRGELLRRHPPGGVRFSGLHSVQGGCGTPGGQARPHSRVEVCGHPGARATGWRDSQPRVCALREGTPALRAVPGHHGWETATLTVLHWLPR

SEQ ID NO: 8057 - protein, 203 aa, Homo sapiens
  Payload ID: 1675;
  Gene Symbol: ATG4D;
  Gene Name: autophagy related 4D, cysteine peptidase;
  ENSP ID: ENSP00000468780
  MOD_RES (1)..(1): Any amino acid
XLPRDWTWAEGMGLGPPELSGSASPSRYHGPARWMPPRWAQGAPELEQERRHRQIVSWFADHPRAPFGLHRLVELGQSSGKKAGDWKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLE

SEQ ID NO: 8058 - protein, 275 aa, Homo sapiens
  Payload ID: 1676;
  Gene Symbol: ATG5;
  Gene Name: autophagy related 5;
  Uniprot ID:  Q9H1Y0;
  ENSP ID: ENSP00000343313
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 8059 - protein, 91 aa, Homo sapiens
  Payload ID: 1676;
  Gene Symbol: ATG5;
  Gene Name: autophagy related 5;
  ENSP ID: ENSP00000353884
MTDDKDVLRDVWFGRIPTCFTLYQDEITEREAEPYYTDLTSFGPSIGNSWNILQKKMDFVISPLEYIRQRLKDLSFRSCFVLWLQMDSCTH

SEQ ID NO: 8060 - protein, 197 aa, Homo sapiens
  Payload ID: 1676;
  Gene Symbol: ATG5;
  Gene Name: autophagy related 5;
  Uniprot ID:  Q9H1Y0;
  ENSP ID: ENSP00000358066
MHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 8061 - protein, 275 aa, Homo sapiens; identical to SEQ ID NO: 8058
  Payload ID: 1676;
  Gene Symbol: ATG5;
  Gene Name: autophagy related 5;
  Uniprot ID:  Q9H1Y0;
  ENSP ID: ENSP00000358072

SEQ ID NO: 8062 - protein, 162 aa, Homo sapiens
  Payload ID: 1676;
  Gene Symbol: ATG5;
  Gene Name: autophagy related 5;
  ENSP ID: ENSP00000483135
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDND

SEQ ID NO: 8063 - protein, 703 aa, Homo sapiens
  Payload ID: 1677;
  Gene Symbol: ATG7;
  Gene Name: autophagy related 7;
  Uniprot ID:  O95352;
  ENSP ID: ENSP00000346437
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEIWDMSDDETI

SEQ ID NO: 8064 - protein, 676 aa, Homo sapiens
  Payload ID: 1677;
  Gene Symbol: ATG7;
  Gene Name: autophagy related 7;
  Uniprot ID:  O95352;
  ENSP ID: ENSP00000347042
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQVLDQYEREGFNFLAKVFNSSHSFLEDLTGLTLLHQETQAAEIWDMSDDETI

SEQ ID NO: 8065 - protein, 96 aa, Homo sapiens
  Payload ID: 1677;
  Gene Symbol: ATG7;
  Gene Name: autophagy related 7;
  ENSP ID: ENSP00000388295
  MOD_RES (1)..(1): Any amino acid
XGYAIASSSDDRMNEPPTSLGLVPHQIRGFLSRFDNVLPVSLAFDKCTACSSKVLDQYEREGFNFLAKVFNSSHSFLEDLTGLTLLHQETQAAEHL

SEQ ID NO: 8066 - protein, 76 aa, Homo sapiens
  Payload ID: 1677;
  Gene Symbol: ATG7;
  Gene Name: autophagy related 7;
  ENSP ID: ENSP00000389012
MAAATGDPGLSKLQFAPFSSALDVGFWHELTQKKLNEYRLDEAPKDIKGYYYNGDSAGLPARLTLEFSAFDIYGNP

SEQ ID NO: 8067 - protein, 93 aa, Homo sapiens
  Payload ID: 1677;
  Gene Symbol: ATG7;
  Gene Name: autophagy related 7;
  ENSP ID: ENSP00000389996
MAAATGDPGLSKLQFAPFSSALDVGFWHELTQKKLNEYRLDEAPKDIKGYYYNGDSAGLPARLTLEFSAFDMSAPTPARCCPAIGTLYNTNTL

SEQ ID NO: 8068 - protein, 66 aa, Homo sapiens
  Payload ID: 1677;
  Gene Symbol: ATG7;
  Gene Name: autophagy related 7;
  ENSP ID: ENSP00000390547
MAAATGDPGLSKLQFAPFSSALDVGFWHELTQKKLNEYRLDEAPKDIKGYYYNGDSAGLPARLTLE

SEQ ID NO: 8069 - protein, 105 aa, Homo sapiens
  Payload ID: 1677;
  Gene Symbol: ATG7;
  Gene Name: autophagy related 7;
  ENSP ID: ENSP00000393075
PALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHR

SEQ ID NO: 8070 - protein, 139 aa, Homo sapiens
  Payload ID: 1677;
  Gene Symbol: ATG7;
  Gene Name: autophagy related 7;
  ENSP ID: ENSP00000406398
  MOD_RES (1)..(1): Any amino acid
XGYAIASSSDDRMNEPPTSLGLVPHQIRGFLSRFDNVLPVSLAFDKCTACSSKVLDQYEREGFNFLAKVFNSSHSFLEDLTGLTLLHQETQAAEDHLSFIRPKNGTFPAHQATCTQESAACPEIDLYQLSSRTIPCIHT

SEQ ID NO: 8071 - protein, 95 aa, Homo sapiens
  Payload ID: 1677;
  Gene Symbol: ATG7;
  Gene Name: autophagy related 7;
  ENSP ID: ENSP00000407340
RGYAIASSSDDRMNEPPTSLGLVPHQIRGFLSRFDNVLPVSLAFDKCTACSSKVLDQYEREGFNFLAKVFNSSHSFLEDLTGLTLLHQETQAAEH

SEQ ID NO: 8072 - protein, 89 aa, Homo sapiens
  Payload ID: 1677;
  Gene Symbol: ATG7;
  Gene Name: autophagy related 7;
  ENSP ID: ENSP00000408303
MAAATGDPGLSKLQFAPFSSALDVGFWHELTQKKLNEYRLDEAPKDIKGYYYNGDSAGLPARLTLEFSAFDMSAPTPARCCPAIGTLYN

SEQ ID NO: 8073 - protein, 77 aa, Homo sapiens
  Payload ID: 1677;
  Gene Symbol: ATG7;
  Gene Name: autophagy related 7;
  ENSP ID: ENSP00000409844
  MOD_RES (1)..(1): Any amino acid
XALENPVLLNKFLLLTFADLKKYHFYYWFCYPALCLPESLPLIQGPVGLDQRFSLKQIVLKQLDGKRTRKEAWDQGW

SEQ ID NO: 8074 - protein, 152 aa, Homo sapiens
  Payload ID: 1677;
  Gene Symbol: ATG7;
  Gene Name: autophagy related 7;
  ENSP ID: ENSP00000411880
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFAIEALECAYDNLCQTE

SEQ ID NO: 8075 - protein, 623 aa, Homo sapiens
  Payload ID: 1677;
  Gene Symbol: ATG7;
  Gene Name: autophagy related 7;
  Uniprot ID:  O95352;
  ENSP ID: ENSP00000412580
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFAIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKIWDMSDDETI

SEQ ID NO: 8076 - protein, 176 aa, Homo sapiens
  Payload ID: 1677;
  Gene Symbol: ATG7;
  Gene Name: autophagy related 7;
  ENSP ID: ENSP00000415223
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQ

SEQ ID NO: 8077 - protein, 126 aa, Homo sapiens
  Payload ID: 1677;
  Gene Symbol: ATG7;
  Gene Name: autophagy related 7;
  ENSP ID: ENSP00000416644
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPV

SEQ ID NO: 8078 - protein, 839 aa, Homo sapiens
  Payload ID: 1678;
  Gene Symbol: ATG9A;
  Gene Name: autophagy related 9A;
  Uniprot ID:  Q7Z3C6;
  ENSP ID: ENSP00000355173
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 8079 - protein, 839 aa, Homo sapiens; identical to SEQ ID NO: 8078
  Payload ID: 1678;
  Gene Symbol: ATG9A;
  Gene Name: autophagy related 9A;
  Uniprot ID:  Q7Z3C6;
  ENSP ID: ENSP00000379983

SEQ ID NO: 8080 - protein, 528 aa, Homo sapiens
  Payload ID: 1678;
  Gene Symbol: ATG9A;
  Gene Name: autophagy related 9A;
  Uniprot ID:  Q7Z3C6;
  ENSP ID: ENSP00000386482
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGVHFGRVAEPHCHTPHPHLLPAPTGPGDYRLLPKLHRGGRWCGRYLLLCSDGCSPAWSSPVAICWADRGLSVPAS

SEQ ID NO: 8081 - protein, 778 aa, Homo sapiens
  Payload ID: 1678;
  Gene Symbol: ATG9A;
  Gene Name: autophagy related 9A;
  Uniprot ID:  Q7Z3C6;
  ENSP ID: ENSP00000386535
MLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 8082 - protein, 839 aa, Homo sapiens; identical to SEQ ID NO: 8078
  Payload ID: 1678;
  Gene Symbol: ATG9A;
  Gene Name: autophagy related 9A;
  Uniprot ID:  Q7Z3C6;
  ENSP ID: ENSP00000386710

SEQ ID NO: 8083 - protein, 98 aa, Homo sapiens
  Payload ID: 1678;
  Gene Symbol: ATG9A;
  Gene Name: autophagy related 9A;
  ENSP ID: ENSP00000390704
MAQFDTEYQRLEASYSDSPPGEEDLLVHVAEGSKSPWHHIENLDLFFSRTFIICTRRMASHVCSSGRSLSSCSSSLWLPSLPSWSAAWTMTSYLPTRW

SEQ ID NO: 8084 - protein, 98 aa, Homo sapiens; identical to SEQ ID NO: 8083
  Payload ID: 1678;
  Gene Symbol: ATG9A;
  Gene Name: autophagy related 9A;
  ENSP ID: ENSP00000393708

SEQ ID NO: 8085 - protein, 93 aa, Homo sapiens
  Payload ID: 1678;
  Gene Symbol: ATG9A;
  Gene Name: autophagy related 9A;
  ENSP ID: ENSP00000394345
MAQFDTEYQRLEASYSDSPPGEEDLLVHVAEGSKSPWHHIENLDLFFSRVYNLHQKNGFTCMLIGEIFELMQFLFVVAFTTFLVSCVDYDILF

SEQ ID NO: 8086 - protein, 133 aa, Homo sapiens
  Payload ID: 1678;
  Gene Symbol: ATG9A;
  Gene Name: autophagy related 9A;
  ENSP ID: ENSP00000396404
MVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLP

SEQ ID NO: 8087 - protein, 255 aa, Homo sapiens
  Payload ID: 1678;
  Gene Symbol: ATG9A;
  Gene Name: autophagy related 9A;
  ENSP ID: ENSP00000398528
  MOD_RES (1)..(1): Any amino acid
XRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 8088 - protein, 244 aa, Homo sapiens
  Payload ID: 1678;
  Gene Symbol: ATG9A;
  Gene Name: autophagy related 9A;
  ENSP ID: ENSP00000400234
LAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGSTSSRPRLN

SEQ ID NO: 8089 - protein, 187 aa, Homo sapiens
  Payload ID: 1678;
  Gene Symbol: ATG9A;
  Gene Name: autophagy related 9A;
  ENSP ID: ENSP00000401530
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARI

SEQ ID NO: 8090 - protein, 172 aa, Homo sapiens
  Payload ID: 1678;
  Gene Symbol: ATG9A;
  Gene Name: autophagy related 9A;
  ENSP ID: ENSP00000404750
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPM

SEQ ID NO: 8091 - protein, 144 aa, Homo sapiens
  Payload ID: 1678;
  Gene Symbol: ATG9A;
  Gene Name: autophagy related 9A;
  ENSP ID: ENSP00000406785
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWI

SEQ ID NO: 8092 - protein, 169 aa, Homo sapiens
  Payload ID: 1678;
  Gene Symbol: ATG9A;
  Gene Name: autophagy related 9A;
  ENSP ID: ENSP00000409164
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALR

SEQ ID NO: 8093 - protein, 131 aa, Homo sapiens
  Payload ID: 1678;
  Gene Symbol: ATG9A;
  Gene Name: autophagy related 9A;
  ENSP ID: ENSP00000413569
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGS

SEQ ID NO: 8094 - protein, 97 aa, Homo sapiens
  Payload ID: 1678;
  Gene Symbol: ATG9A;
  Gene Name: autophagy related 9A;
  ENSP ID: ENSP00000416435
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKM

SEQ ID NO: 8095 - protein, 924 aa, Homo sapiens
  Payload ID: 1679;
  Gene Symbol: ATG9B;
  Gene Name: autophagy related 9B;
  Uniprot ID:  Q674R7;
  ENSP ID: ENSP00000475737
MVSRMGWGGRRRRLGRWGDLGPGSVPLLPMPLPPPPPPSCRGPGGGRISIFSLSPAPHTRSSPSSFSPPTAGPPCSVLQGTGASQSCHSALPIPATPPTQAQPAMTPASASPSWGSHSTPPLAPATPTPSQQCPQDSPGLRVGPLIPEQDYERLEDCDPEGSQDSPIHGEEQQPLLHVPEGLRGSWHHIQNLDSFFTKIYSYHQRNGFACILLEDVFQLGQFIFIVTFTTFLLRCVDYNVLFANQPSNHTRPGPFHSKVTLSDAILPSAQCAERIRSSPLLVLLLVLAAGFWLVQLLRSVCNLFSYWDIQVFYREALHIPPEELSSVPWAEVQSRLLALQRSGGLCVQPRPLTELDIHHRILRYTNYQVALANKGLLPARCPLPWGGSAAFLSRGLALNVDLLLFRGPFSLFRGGWELPHAYKRSDQRGALAARWGRTVLLLAALNLALSPLVLAWQVLHVFYSHVELLRREPGALGARGWSRLARLQLRHFNELPHELRARLARAYRPAAAFLRTAAPPAPLRTLLARQLVFFAGALFAALLVLTVYDEDVLAVEHVLTAMTALGVTATVARSFIPEEQCQGRAPQLLLQTALAHMHYLPEEPGPGGRDRAYRQMAQLLQYRAVSLLEELLSPLLTPLFLLFWFRPRALEIIDFFHHFTVDVAGVGDICSFALMDVKRHGHPQWLSAGQTEASLSQRAEDGKTELSLMRFSLAHPLWRPPGHSSKFLGHLWGRVQQDAAAWGATSARGPSTPGVLSNCTSPLPEAFLANLFVHPLLPPRDLSPTAPCPAAATASLLASISRIAQDPSSVSPGGTGGQKLAQLPELASAEMSLHVIYLHQLHQQQQQQEPWGEAAASILSRPCSSPSQPPSPDEEKPSWSSDGSSPASSPRQQWGTQKARNLFPGGFQVTTDTQKEPDRASCTD

SEQ ID NO: 8096 - protein, 924 aa, Homo sapiens; identical to SEQ ID NO: 8095
  Payload ID: 1679;
  Gene Symbol: ATG9B;
  Gene Name: autophagy related 9B;
  Uniprot ID:  Q674R7;
  ENSP ID: ENSP00000479879

SEQ ID NO: 8097 - protein, 1208 aa, Homo sapiens
  Payload ID: 1680;
  Gene Symbol: AMBRA1;
  Gene Name: autophagy/beclin-1 regulator 1;
  Uniprot ID:  Q9C0C7;
  ENSP ID: ENSP00000318313
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRLLESSLISLSRYDGAGSREHPIYPDPARLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 8098 - protein, 1298 aa, Homo sapiens
  Payload ID: 1680;
  Gene Symbol: AMBRA1;
  Gene Name: autophagy/beclin-1 regulator 1;
  Uniprot ID:  Q9C0C7;
  ENSP ID: ENSP00000415327
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRLLESSLISLSRYDGAGSREHPIYPDPARLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 8099 - protein, 24 aa, Homo sapiens
  Payload ID: 1680;
  Gene Symbol: AMBRA1;
  Gene Name: autophagy/beclin-1 regulator 1;
  ENSP ID: ENSP00000431486
MKVVPEKNAVRILWGRERGARAMG

SEQ ID NO: 8100 - protein, 1238 aa, Homo sapiens
  Payload ID: 1680;
  Gene Symbol: AMBRA1;
  Gene Name: autophagy/beclin-1 regulator 1;
  Uniprot ID:  Q9C0C7;
  ENSP ID: ENSP00000431926
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRRLLESSLISLSRYDGAGSREHPIYPDPARDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 8101 - protein, 1179 aa, Homo sapiens
  Payload ID: 1680;
  Gene Symbol: AMBRA1;
  Gene Name: autophagy/beclin-1 regulator 1;
  ENSP ID: ENSP00000433372
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 8102 - protein, 1269 aa, Homo sapiens
  Payload ID: 1680;
  Gene Symbol: AMBRA1;
  Gene Name: autophagy/beclin-1 regulator 1;
  Uniprot ID:  Q9C0C7;
  ENSP ID: ENSP00000433945
MKVVPEKNAVRILWGRERGARAMGAQRLLQELVEDKTRWMKWEGKRVELPDSPRSTFLLAFSPDRTLLASTHVNHNIYITEVKTGKCVHSLIGHRRTPWCVTFHPTISGLIASGCLDGEVRIWDLHGGSESWFTDSNNAIASLAFHPTAQLLLIATANEIHFWDWSRREPFAVVKTASEMERVRLVRFDPLGHYLLTAIVNPSNQQGDDEPEIPIDGTELSHYRQRALLQSQPVRRTPLLHNFLHMLSSRSSGIQVGEQSTVQDSATPSPPPPPPQPSTERPRTSAYIRLRQRVSYPTAECCQHLGILCLCSRCSGTRVPSLLPHQDSVPPASARATTPSFSFVQTEPFHPPEQASSTQQDQGLLNRPSAFSTVQSSTAGNTLRNLSLGPTRRSLGGPLSSHPSRYHREIAPGLTGSEWTRTVLSLNSRSEAESMPPPRTSASSVSLLSVLRQQEGGSQASVYTSATEGRGFPASGLATESDGGNGSSQNNSGSIRHELQCDLRRFFLEYDRLQELDQSLSGEAPQTQQAQEMLNNNIESERPGPSHQPTPHSSENNSNLSRGHLNRCRACHNLLTFNNDTLRWERTTPNYSSGEASSSWQVPSSFESVPSSGSQLPPLERTEGQTPSSSRLELSSSASPQEERTVGVAFNQETGHWERIYTQSSRSGTVSQEALHQDMPEESSEEDSLRRLSPAAYYAQRMIQYLSRRDSIRQRSMRYQQNRLRSSTSSSSSDNQGPSVEGTDLEFEDFEDNGDRSRHRAPRNARMSAPSLGRFVPRRFLLPEYLPYAGIFHERGQPGLATHSSVNRVLAGAVIGDGQSAVASNIANTTYRLQWWDFTKFDLPEISNASVNVLVQNCKIYNDASCDISADGQLLAAFIPSSQRGFPDEGILAVYSLAPHNLGEMLYTKRFGPNAISVSLSPMGRYVMVGLASRRILLHPSTEHMVAQVFRLQQAHGGETSMRRVFNVLYPMPADQRRHVSINSARWLPEPGLGLAYGTNKGDLVICRPEALNSGVEYYWDQLNETVFTVHSNSRSSERPGTSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 8103 - protein, 256 aa, Homo sapiens
  Payload ID: 1680;
  Gene Symbol: AMBRA1;
  Gene Name: autophagy/beclin-1 regulator 1;
  ENSP ID: ENSP00000434895
NSARWLPEPGLGLAYGTNKGDLVICRPETSRATWRTDRDMGLMNAIGLQPRNPATSVTSQGTQTLALQLQNAETQTEREVPEPGTAASGPGEGEGSEYGASGEDALSRIQRLMAEGGMTAVVQREQSTTMASMGGFGNNIIVSHRIHRSSQTGTEPGAAHTSSPQPSTSRGLLPEAGQLAERGLSPRTASWDQPGTPGREPTQPTLPSSSPVPIPVSLPSAEGPTLHCELTNNNHLLDGGSSRGDAAGPRGEPRNR

SEQ ID NO: 8104 - protein, 648 aa, Homo sapiens
  Payload ID: 1681;
  Gene Symbol: AVL9;
  Gene Name: AVL9 homolog (S. cerevisiase);
  Uniprot ID:  Q8NBF6;
  ENSP ID: ENSP00000315568
MEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLDNEKILSDYGTTFVTAWKNTHNYRVWNSNKHPALAEINPNHPFQGQYSVSDMKLRFSHSVQNSERGKKIGNVMVTTSRNVVQTGKAVGQSVGGAFSSAKTAMSSWLSTFTTSTSQSLTEPPDEKP

SEQ ID NO: 8105 - protein, 630 aa, Homo sapiens
  Payload ID: 1681;
  Gene Symbol: AVL9;
  Gene Name: AVL9 homolog (S. cerevisiase);
  ENSP ID: ENSP00000387011
MEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLDNEKILSDYGTTFVTAWKNTHNYRVWNSNKHPALAEINPNSVQNSERGKKIGNVMVTTSRNVVQTGKAVGQSVGGAFSSAKTAMSSWLSTFTTSTSQSLTEPPDEKP

SEQ ID NO: 8106 - protein, 568 aa, Homo sapiens
  Payload ID: 1681;
  Gene Symbol: AVL9;
  Gene Name: AVL9 homolog (S. cerevisiase);
  ENSP ID: ENSP00000395134
QEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLVLFRIVNVAKKLETSWSQLAGMLYKQEKLLASQLEELFPVQRQLCLHGFPLSPLPPPKVSLSHQMRSLEQGVRGCYCFLRFKCPLSVCCSQAVTSHRSTAGDHMSNCLHGCCSK

SEQ ID NO: 8107 - protein, 862 aa, Homo sapiens
  Payload ID: 1682;
  Gene Symbol: AXIN1;
  Gene Name: axin 1;
  Uniprot ID:  O15169;
  ENSP ID: ENSP00000262320
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRYVQEVMRRGRACVRPACAPVLHVVPAVSDMELSETETRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 8108 - protein, 826 aa, Homo sapiens
  Payload ID: 1682;
  Gene Symbol: AXIN1;
  Gene Name: axin 1;
  Uniprot ID:  O15169;
  ENSP ID: ENSP00000346935
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRTRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 8109 - protein, 102 aa, Homo sapiens
  Payload ID: 1682;
  Gene Symbol: AXIN1;
  Gene Name: axin 1;
  ENSP ID: ENSP00000416835
  MOD_RES (1)..(1): Any amino acid
XLEEEEKRASRAPSKQRTRSQRKVGGGSAQPCDSIVVAYYFCGEPIPYRTLVRGRAVTLGQFKELLTKKGSYRPPSHLRCCLLTALLTSVLQILLQESERRV

SEQ ID NO: 8110 - protein, 843 aa, Homo sapiens
  Payload ID: 1683;
  Gene Symbol: AXIN2;
  Gene Name: axin 2;
  Uniprot ID:  Q9Y2T1;
  ENSP ID: ENSP00000302625
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGGSRGSTLPKRNGKGTEPGLALPAREGGAPGGAGALQLPREEGDRSQDVWQWMLESERQSKPKPHSAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 8111 - protein, 778 aa, Homo sapiens
  Payload ID: 1683;
  Gene Symbol: AXIN2;
  Gene Name: axin 2;
  ENSP ID: ENSP00000364854
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 8112 - protein, 150 aa, Homo sapiens
  Payload ID: 1683;
  Gene Symbol: AXIN2;
  Gene Name: axin 2;
  ENSP ID: ENSP00000441151
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLK

SEQ ID NO: 8113 - protein, 191 aa, Homo sapiens
  Payload ID: 1683;
  Gene Symbol: AXIN2;
  Gene Name: axin 2;
  ENSP ID: ENSP00000463192
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFL

SEQ ID NO: 8114 - protein, 192 aa, Homo sapiens
  Payload ID: 1683;
  Gene Symbol: AXIN2;
  Gene Name: axin 2;
  ENSP ID: ENSP00000463761
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLT

SEQ ID NO: 8115 - protein, 271 aa, Homo sapiens
  Payload ID: 1683;
  Gene Symbol: AXIN2;
  Gene Name: axin 2;
  ENSP ID: ENSP00000464264
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGY

SEQ ID NO: 8116 - protein, 778 aa, Homo sapiens; identical to SEQ ID NO: 8111
  Payload ID: 1683;
  Gene Symbol: AXIN2;
  Gene Name: axin 2;
  ENSP ID: ENSP00000478916

SEQ ID NO: 8117 - protein, 160 aa, Homo sapiens
  Payload ID: 1683;
  Gene Symbol: AXIN2;
  Gene Name: axin 2;
  ENSP ID: ENSP00000481191
MSSAMLVTCLPDPSSSFREDAPRPPVPGEEGETPPCQPGVGKGQVTKPMPVSSNTRRNEDGLGEPEGRASPDSPLTRWTKSLHSLLGDQDGAYLFRTFLEREKCVDTLDFWFACNGFRQMNLKDTKTLRVAKDFCHDILFYLYCKLCIIKSSFKENYLVQ

SEQ ID NO: 8118 - protein, 306 aa, Homo sapiens
  Payload ID: 1684;
  Gene Symbol: AIDA;
  Gene Name: axin interactor, dorsalization associated;
  Uniprot ID:  Q96BJ3;
  ENSP ID: ENSP00000339161
MSEVTRSLLQRWGASFRRGADFDSWGQLVEAIDEYQILARHLQKEAQAQHNNSEFTEEQKKTIGKIATCLELRSAALQSTQSQEEFKLEDLKKLEPILKNILTYNKEFPFDVQPVPLRRILAPGEEENLEFEEDEEEGGAGAGSPDSFPARVPGTLLPRLPSEPGMTLLTIRIEKIGLKDAGQCIDPYITVSVKDLNGIDLTPVQDTPVASRKEDTYVHFNVDIELQKHVEKLTKGAAIFFEFKHYKPKKRFTSTKCFAFMEMDEIKPGPIVIELYKKPTDFKRKKLQLLTKKPLYLHLHQTLHKE

SEQ ID NO: 8119 - protein, 224 aa, Homo sapiens
  Payload ID: 1684;
  Gene Symbol: AIDA;
  Gene Name: axin interactor, dorsalization associated;
  Uniprot ID:  Q96BJ3;
  ENSP ID: ENSP00000347964
MSEVTRSLLQRWGASFRRGADFDSWGQLVEAIDEYQILARHLQKEAQAQHNNSEFTEEQKKTIGKIATCLELRSAALQSTQSQEEFKLEDLKKLEPILKNILTYNKEFPFDVQPVPLRRILAPGEEENLEFEEDEEEGGAGAGSPDSFPARVPGAAIFFEFKHYKPKKRFTSTKCFAFMEMDEIKPGPIVIELYKKPTDFKRKKLQLLTKKPLYLHLHQTLHKE

SEQ ID NO: 8120 - protein, 894 aa, Homo sapiens
  Payload ID: 1685;
  Gene Symbol: AXL;
  Gene Name: AXL receptor tyr kinase;
  Uniprot ID:  P30530;
  ENSP ID: ENSP00000301178
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 8121 - protein, 885 aa, Homo sapiens
  Payload ID: 1685;
  Gene Symbol: AXL;
  Gene Name: AXL receptor tyr kinase;
  Uniprot ID:  P30530;
  ENSP ID: ENSP00000351995
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 8122 - protein, 626 aa, Homo sapiens
  Payload ID: 1685;
  Gene Symbol: AXL;
  Gene Name: AXL receptor tyr kinase;
  ENSP ID: ENSP00000471497
MGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 8123 - protein, 1012 aa, Homo sapiens
  Payload ID: 1686;
  Gene Symbol: AXDND1;
  Gene Name: axonemal dynein light chain domain containing 1;
  Uniprot ID:  Q5T1B0;
  ENSP ID: ENSP00000356590
MSLPKTPSTPLNSTSTSESKKLKVSVAKEGTRGLPELKEKKNMVDRSKLLPTSLQNEFIPKEVLLSLTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHKPKTLTDTLIPEEFHIVSSTGVSGLECYDDKYTTLLTDSENRLLLFPSMKPNKRVEVAQLNDVMDTMLERAGVENQEYTGPTKMHKLLHILKKEQTIYNMIFHELIRQVSVDCADRGELLSKVRERYVQMLDQIARQMIDFYKDLVTQRVMDQRILEELYNFKHVIEELTRELCLVRAHDVKLTKETEKAHKDLAQALLNAEKNAKIVEEYHDLYTLQRERMENDMKKLVAERDIWSSATYELALKVIERNRVILARRLYLNEKGWNKYTKHFIILLSNKDTEDLALLQKLTQKWRNLVNKLKQEVEQMEESTSETLKIVKDGLIKWQEFFNEKDILSPNKGNIFNSVLLDFKQWQKILNEKKEEFTGDVLLSKYDTLKIIKHLQENWADIGLGIFNRHKSLEGEMPSERQYMEEIIKNIQKLYKEYEIRINGDNGYSKILPSLISSLDFCSFKLENLEFPDTPLEEWQEIDEKINEMKSHLDILLNLTGIVPQHIDVDSVSVLQAYIFNMIQQWLLKIGNEINNGNIELQHHMDELHISMIQWMVNLLILMIPNFTDQDCLLKLEEESAEKHDIGVARLELDAIELTRKLYQYSSYLSSCCKGMVTAMALSKSTNSHKNATEDLYEVDKLKKECYEWINTCSCLLSNIKGRKITLLTYEEIERLLEEEAVKEFIEPEIDESFKEDEEESKEDRKLQEENKERAEEQPSTSTEKEKLIRFIGEDENVHSKPLFETDVLSSWRESAKQGTLAQKYLEAMAVIEHMQEKLLEVENRARQAEEKFEDAYEKLHHTLIKNKDLEELVMTSRKESKEEKENQDEREVKEEEEQQEEEEVRSAENSSKSPKKGH

SEQ ID NO: 8124 - protein, 872 aa, Homo sapiens
  Payload ID: 1686;
  Gene Symbol: AXDND1;
  Gene Name: axonemal dynein light chain domain containing 1;
  ENSP ID: ENSP00000391716
LTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHKPKTLTDTLIPEEFHIVSSTGVSGLECYDDKYTTLLTDSENRLLLFPSMKPNKRVEVAQLNDVMDTMLERAGVENQEYTGPTKMHKLLHILKKEQTIYNMIFHELIRQVSVDCADRGELLSKVRERYVQMLDQIARQMIDFYKDLVTQRVMDQRILEELYNFKHVIEELTRELCLVRAHDVKLTKETEKAHKDLAQALLNAEKNAKIVEEYHDLYTLQRERMENDMKKLVAERDIWSSATYELALKVIERNRVILARRLYLNEKGWNKYTKHFIILLSNKDTEDLALLQKLTQKWRNLVNKLKQEVEQMEESTSETLKIVKDGLIKWQEFFNEKDILSPNKGNIFNSVLLDFKQWQKILNEKKEEFTGDVLLSKYDTLKIIKHLQENWADIGLGIFNRHKSLEGEMPSERQYMEEIIKNIQKLYKEYEIRINGDNGYSKILPSLISSLDFCSFKLENLEFPDTPLEEWQEIDEKINEMKSHLDILLNLTGIVPQHIDVDSVSVLQAYIFNMIQQWLLKIGNEINNGNIELQHHMDELHISMIQWMVNLLILMIPNFTDQDCLLKLEEESAEKHDIGVARLELDAIELTRKLYQYSSYLSSCCKGMVTAMALSKSTNSHKNATEDLYEVDKLKQPSTSTEKEKLIRFIGEDENVHSKPLFETDVLSSWRESAKQGTLAQKYLEAMAVIEHMQEKLLEVENRARQAEEKFEDAYEKLHHTLIKNKDLEELVMTSRKESKEEKENQDEREVKEEEEQQEEEEVRSAENSSKSPKKGH

SEQ ID NO: 8125 - protein, 672 aa, Homo sapiens
  Payload ID: 1686;
  Gene Symbol: AXDND1;
  Gene Name: axonemal dynein light chain domain containing 1;
  ENSP ID: ENSP00000416712
MSLPKTPSTPLNSTSTSESKKLKVSVAKEGTRGLPELKEKKNMVDRSKLLPTSLQNEFIPKEVLLSLTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHKPKTLTDTLIPEEFHIVSSTGVSGLECYDDKYTTLLTDSENRLLLFPSMKPNKRVEVAQLNDVMDTMLERAGVENQEYTGPTKMHKLLHILKKEQTIYNMIFHELIRQVSVDCADRGELLSKVRERYVQMLDQIARQMIDFYKDLVTQRVMDQRILEELYNFKHVIEELTRELCLVRAHDVKLTKETEKAHKDLAQALLNAEKNAKIVEEYHDLYTLQRERMENDMKKLVAERDIWSSATYELALKVIERNRVILARRLYLNEKGWNKYTKHFIILLSNKDTEDLALLQKLTQKWRNLVNKLKQEVEQMEESTSETLKIVKDGLIKWQEFFNEKDILSPNKGNIFNSVLLDFKQWQKILNEKKEEFTGDVLLSKYDTLKIIKHLQENWADIGLGIFNRHKSLEGEMPSERQYMEEIIKNIQKLYKEYEIRINGDNGYSKILPSLISSLDFCSFKLENLEFPDTPLEEWQEIDEKINEMKSHLDILLNLTGCSTAHRCGFCFGTPSVYI

SEQ ID NO: 8126 - protein, 78 aa, Homo sapiens
  Payload ID: 1686;
  Gene Symbol: AXDND1;
  Gene Name: axonemal dynein light chain domain containing 1;
  ENSP ID: ENSP00000422992
MSLPKTPSTPLNSTSTSESKKLKVSVAKEGTRGLPELKEKKNMVDRSKLLPTSLQNEFIPKEVLLSLTYAANAGPCPE

SEQ ID NO: 8127 - protein, 529 aa, Homo sapiens
  Payload ID: 1686;
  Gene Symbol: AXDND1;
  Gene Name: axonemal dynein light chain domain containing 1;
  ENSP ID: ENSP00000424373
MSLPKTPSTPLNSTSTSESKKLKVSVAKEGTRGLPELKEKKNMVDRSKLLPTSLQNEFIPKEVLLSLTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHKPKTLTDTLIPEEFHIVSSTGVSGLECYDDKYTTLLTDSENRLLLFPSMKPNKRVEVAQLNDVMDTMLERAGVENQEYTGPTKMHKLLHILKKEQTIYNMIFHELIRQVSVDCADRGELLSKVRERYVQMLDQIARQMIDFYKDLVTQRVMDQRILEELYNFKHVIEELTRELCLVRAHDVKLTKETEKAHKDLAQALLNAEKNAKIVEEYHDLYTLQRERMENDMKKLVAERDIWSSATYELALKVIERNRVILARRLYLNEKGWNKYTKHFIILLSNKDTEDLALLQKLTQKWRNLVNKLKQEVEQMEESTSETLKIVKDGLIKWQEFFNEKDILSPNKGNIFNSVLLDFKQWQKVTPKFFQV

SEQ ID NO: 8128 - protein, 151 aa, Homo sapiens
  Payload ID: 1686;
  Gene Symbol: AXDND1;
  Gene Name: axonemal dynein light chain domain containing 1;
  ENSP ID: ENSP00000425019
MVDRSKLLPTSLQNEFIPKEVLLSLTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHKPKTLTDTLIPEEFHIVSSTGVSGLECYD

SEQ ID NO: 8129 - protein, 123 aa, Homo sapiens
  Payload ID: 1686;
  Gene Symbol: AXDND1;
  Gene Name: axonemal dynein light chain domain containing 1;
  ENSP ID: ENSP00000425198
MVDRSKLLPTSLQNEFIPKEVLLSLTYAANAGPCPENLLPPKKIKTPKGTLPRLVDHVWHHPVRRNKFKYLIDHPVSLTGAGRDISFLYDVTYAKGQTREKAVCPPHLARSLQSHDGVIVPHK

SEQ ID NO: 8130 - protein, 529 aa, Homo sapiens; identical to SEQ ID NO: 8127
  Payload ID: 1686;
  Gene Symbol: AXDND1;
  Gene Name: axonemal dynein light chain domain containing 1;
  ENSP ID: ENSP00000482167

SEQ ID NO: 8131 - protein, 251 aa, Homo sapiens
  Payload ID: 1687;
  Gene Symbol: AZU1;
  Gene Name: azurocidin 1;
  Uniprot ID:  P20160;
  ENSP ID: ENSP00000233997
MTRLTVLALLAGLLASSRAGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNGDGGTPLVCEGLAHGVASFSLGPCGRGPDFFTRVALFRDWIDGVLNNPGPGPA

SEQ ID NO: 8132 - protein, 251 aa, Homo sapiens; identical to SEQ ID NO: 8131
  Payload ID: 1687;
  Gene Symbol: AZU1;
  Gene Name: azurocidin 1;
  Uniprot ID:  P20160;
  ENSP ID: ENSP00000479183

SEQ ID NO: 8133 - protein, 150 aa, Homo sapiens
  Payload ID: 1687;
  Gene Symbol: AZU1;
  Gene Name: azurocidin 1;
  ENSP ID: ENSP00000481172
MTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNVSAPCGGRRGPERY

SEQ ID NO: 8134 - protein, 150 aa, Homo sapiens; identical to SEQ ID NO: 8133
  Payload ID: 1687;
  Gene Symbol: AZU1;
  Gene Name: azurocidin 1;
  ENSP ID: ENSP00000488091

SEQ ID NO: 8135 - protein, 289 aa, Homo sapiens
  Payload ID: 1688;
  Gene Symbol: BTLA;
  Gene Name: B and T lymphocyte associated;
  Uniprot ID:  Q7Z6A9;
  ENSP ID: ENSP00000333919
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 8136 - protein, 241 aa, Homo sapiens
  Payload ID: 1688;
  Gene Symbol: BTLA;
  Gene Name: B and T lymphocyte associated;
  Uniprot ID:  Q7Z6A9;
  ENSP ID: ENSP00000373178
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 8137 - protein, 2624 aa, Homo sapiens
  Payload ID: 1689;
  Gene Symbol: BDP1;
  Gene Name: B double prime 1, subunit of RNA polymerase III transcription initiation  factor IIIB;
  Uniprot ID:  A6H8Y1;
  ENSP ID: ENSP00000351575
MFRRARLSVKPNVRPGVGARGSTASNPQRGRESPRPPDPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPIMEKVSGKMAVVEEMEADLKETGKENFRERGSEEICVTEEKVAELKQTGKTDISPRENELEETSTSRQTDTHLMQSGSNDFSAVPSLDIQNISSEVLSMMHTPVEEKRNSEKEVSSHFSHFKISSQTHESDKTEVQGIQSPDVPEQFSDINLSKSLPQEQKPLEIKPAPFVRSRFKRPKPNLARAALKRETTESEKYIYEKKSETKKMETIVMQENNEQTDTLPSQHDEASLMISREKDTLGHRNEEAVILPCTQTERNLSPSNSCEPKEESQSAPVQKNDSVVSVGTNNVNTFQQEMKESVIQTARQVRGRLQRPRPNIRKTGQRQIVDKGEAKGIIKEGRTILPKDETEKKVLTVSNSQIETEIEVPSSAVPEHRMYENQSQVVLVENLHVNKTNETIRHENKPYVPSSAQMTRRKFQKAKPNLGRAHSKKEEPVLEKVTTDQSKEGKPEDHLLQKGASNTQLLLKEKAELLTSLEVSARKDCVGSKESALAKIDAELEEVGPSRRVGEETVGDNSPSSVVEEQYLNKLTSCPQPLNETSYSKIALDGKTTISSTSEYERNRGERRSHKKFKPNVTRGRGSKRVRGKTSKKEPRASKAMLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGTNDGSTEAAITLLTMGDLVLQSEISSEQGDVGVCIIPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVNLVANVPQDGEDEQAFILTLVEIPANAVEEFTDATAQFMPNPLLPAPILVKSVNTEERGDMSICLPATSVGQDAMGLSISGRDNSKKPPDNLDLVSRKRFQCRLDKNDHIPPAKKRSLTLRDDCQEYTTEVHSKELTNVFEETGESHKGQDIFLTSGSTLTTPEPQRQQVEAAFQSRGSRSPDACMDKNVPQLPQDEMIVSDKEERTDAAPKSQQMDSRTSSSKASLSRPGRRPLGFLSLICSKNSLESDEPMQVHSKKRLKPLIPGLRKKLKRSNPFNESQEKNRESSDLLPSPSVITTQSENISSSATQVSCDQPLLKEGYKSAQKRAPQGEATTVSEYFFNDIFIEVDETE

SEQ ID NO: 8138 - protein, 846 aa, Homo sapiens
  Payload ID: 1689;
  Gene Symbol: BDP1;
  Gene Name: B double prime 1, subunit of RNA polymerase III transcription initiation  factor IIIB;
  ENSP ID: ENSP00000370050
MFRRARLSVKPNVRPGVGARGSTASNPQRGRESPRPPDPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILSLGKWRQH

SEQ ID NO: 8139 - protein, 583 aa, Homo sapiens
  Payload ID: 1689;
  Gene Symbol: BDP1;
  Gene Name: B double prime 1, subunit of RNA polymerase III transcription initiation  factor IIIB;
  ENSP ID: ENSP00000421910
  MOD_RES (1)..(1): Any amino acid
XRKDCVGSKESALAKIDAELEEVGPSRRVGEETVGDNSPSSVVEEQYLNKLTSCPQPLNETSYSKIALDGKTTISSTSEYERNRGERRSHKKFKPNVTRGRGSKRVRGKTSKKEPRASKAMLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGTNDGSTEAAITLLTMGDLVLQSEISSEQGDGVCIIPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVFVYQQLQLVKMPWVYLFLEEIILKSRLIIWILYLGRDFNAGLIKMTTFLLPKNVHSL

SEQ ID NO: 8140 - protein, 606 aa, Homo sapiens
  Payload ID: 1689;
  Gene Symbol: BDP1;
  Gene Name: B double prime 1, subunit of RNA polymerase III transcription initiation  factor IIIB;
  ENSP ID: ENSP00000432404
TDVTTEEMKQEENLSVPFEMTTSEHIQDEPGVCIIPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVNLVANVPQDGEDEQAFILTLVEIPANAVEEFTDATAQFMPNPLLPAPILVKSVNTEERGDMSICLPATSVGQDAMGLSISGRDNSKKPPDNLDLVSRKRFQCRLDKNDHIPPAKKRSLTLRDDCQEYTTEVHSKELTNVFEETGESHKGQDIFLTSGSTLTTPEPQRQQVEAAFQSRGSRSPDACMDKNVPQLPQDEMIVSDKEERTDAAPKSQQMDSRTSSSKASLSRPGRRPLGFLSLICSKNSLESDEPMQVHSKKRLKPLIPGLRKKLKRSNPFNESQEKNRESSDLLPSPSVITTQSENISSSATQRPF

SEQ ID NO: 8141 - protein, 583 aa, Homo sapiens; identical to SEQ ID NO: 8139
  Payload ID: 1689;
  Gene Symbol: BDP1;
  Gene Name: B double prime 1, subunit of RNA polymerase III transcription initiation  factor IIIB;
  ENSP ID: ENSP00000479056
  MOD_RES (1)..(1): Any amino acid

SEQ ID NO: 8142 - protein, 606 aa, Homo sapiens; identical to SEQ ID NO: 8140
  Payload ID: 1689;
  Gene Symbol: BDP1;
  Gene Name: B double prime 1, subunit of RNA polymerase III transcription initiation  factor IIIB;
  ENSP ID: ENSP00000479247

SEQ ID NO: 8143 - protein, 846 aa, Homo sapiens; identical to SEQ ID NO: 8138
  Payload ID: 1689;
  Gene Symbol: BDP1;
  Gene Name: B double prime 1, subunit of RNA polymerase III transcription initiation  factor IIIB;
  ENSP ID: ENSP00000479517

SEQ ID NO: 8144 - protein, 846 aa, Homo sapiens
  Payload ID: 1689;
  Gene Symbol: BDP1;
  Gene Name: B double prime 1, subunit of RNA polymerase III transcription initiation  factor IIIB;
  ENSP ID: ENSP00000480411
MFRRARLSVKPNVRPGVGARGSTASNPQRGRESPRPPEPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILSLGKWRQH

SEQ ID NO: 8145 - protein, 2624 aa, Homo sapiens
  Payload ID: 1689;
  Gene Symbol: BDP1;
  Gene Name: B double prime 1, subunit of RNA polymerase III transcription initiation  factor IIIB;
  ENSP ID: ENSP00000482112
MFRRARLSVKPNVRPGVGARGSTASNPQRGRESPRPPEPATDSASKPAEPTDVPTVDFGGAEPQEKAPRSSTEKTGGDNDVEESSRSSSTVSQRRKRISSTSSLVKSSVSVPSESHPLSTINQEAPQPTATSTKEKQPCSDRYRIYKAQKLREMLKEELRKEKKQWKNKYAINESQRPPDRSKMTMRDFIYYLPDNNPMTSSLEQEKKTEKPSTPVQTREQEGKSTPNAEDNEMEEETDDGPLLVPRVKVAEDGSIILDEESLTVEVLRTKGPCVVEENDPIFERGSTTTYSSFRKNYYSKPWSNKETDMFFLAISMVGTDFSMIGQLFPHRARIEIKNKFKREEKTNGWRIDKAFQEKRPFDFDFFAHLLQKVLAEEEKRKQKSVKNHSLKEKKSTKPRKNVKVKKVACEGVNNDPDESMSSRISDTERSQKDAQTVEEESLTLSREDAEQVALEVDLNQKKRRRKKQDGANELGVNNLLENATVQAGPSKGEKHKNKCQAIRPELKEGECSKEQMLSCTQNIDGIVGFASTEKVEKRTDPILSLSNQQDATSVATESSESSTSDLPSFEVGIRALCEVNNAEGSCIEERNVDLKNNSLEIDQTENVKPMLRGRFQRPKPNLSRAGKKSVLSQGKTESESKNSHSKTSVEKNHVEKDKMNTLDILRMETTERENPEAETVSVLGEKNCLQEGSQLKALRPVQVRGRLQKPKPNAGKAAERKEILISQEEIGANVEKNENESCADRDTPQHMEDQSRKDFEEEDVILQPEKNDSFQNVQPDEPKVLNECLSVQENNKANKLNQVPILRTRFQKPKPNIGRGTGRREISSKEEVLEKILVSGEMAAALRETVRLDTSPKEMVPAEINTKEMQSDLKETGRRAISPREKILDVIDDTIEMETGLKAMGREICLREKTPEVIDATEEIDKDLEEAGRREISPQKNGPEEVKPLGEVETDLKATGNESSPREKTPEVTDATEEIDKNLEETGRRKISPRENGPEEVKPVDEMETDLNATGRESSPREKTPEVIDATEEIDLEETEREVSPQENGLEEVKPLGEMETDLKATGRDSFPRGKTPEVIDAIEEIEIDLEETEREISPQENGLEEVKPLGEMQTDLKATGREISPREKTPEVIDATEEIDKDLEETGRREISPEENGPEEVKPVDEMETDLKTTGREGSSREKTREVIDAAEVIETDLEETEREISPQENGPEEVKPVGKMETDLKEIREEISQREKVLAEFSAIREKEIDLKETGKRDIPIMEKVSGKMAVVEEMEADLKETGKENFRERGSEEICVTEEKVAELKQTGKTDISPRENELEETSTSRQTDTHLMQSGSNDFSAVPSLDIQNISSEVLSMMHTPVEEKRNSEKEVSSHFSHFKISSQTHESDKTEVQGIQSPDVPEQFSDINLSKSLPQEQKPLEIKPAPFVRSRFKRPKPNLARAALKRETTESEKYIYEKKSETKKMETIVMQENNEQTDTLPSQHDEASLMISREKDTLGHRNEEAVILPCTQTERNLSPSNSCEPKEESQSAPVQKNDSVVSVGTNNVNTFQQEMKESVIQTARQVRGRLQRPRPNIRKTGQRQIVDKGEAKGIIKEGRTILPKDETEKKVLTVSNSQIETEIEVPSSAVPEHRMYENQSQVVLVENLHVNKTNETIRHENKPYVPSSAQMTRRKFQKAKPNLGRAHSKKEEPVLEKVTTDQSKEGKPEDHLLQKGASNTQLLLKEKAELLTSLEVSARKDCVGSKESALAKIDAELEEVGPSRRVGEETVGDNSPSSVVEEQYLNKLTSCPQPLNETSYSKIALDGKTTISSTSEYERNRGERRSHKKFKPNVTRGRGSKRVRGKTSKKEPRASKAMLVTLRASQEEDDDADDFESDYEEESYHLAPEEVNKAPVFVPVGLRSPEPVSAQIEETMEELEITVNVPDVGCIAVVEHELPNTDVTTEEMKQEENLSVPFEMTTSEHIQDEPGTNDGSTEAAITLLTMGDLVLQSEISSEQGDVGVCIIPHVHSKDKSHIPSSLDNVNHKIVHECQELSSPVITTSPASFEENKIVLEEQSSREEISLMEKVKENATPTRNTISKVTSNLRIRSRLAKPKPNLEKTLGTNRLDDYQEVSSLCVTKGAEMETQRETEKNASKATELENKNLGPVTTAENKDQSKLACVHGIKGTSISSEVNLTERNENQEESSQEVHMLSVAPVASSETGPCTLGLDRGLGENSVEEPQIKDSKGDSVLTLPVPEYTPTSIPEVQQENIINPQDLTVNLVANVPQDGEDEQAFILTLVEIPANAVEEFTDATAQFMPNPLLPAPILVKSVNTEERGDMSICLPATSVGQDAMGLSISGRDNSKKPPDNLDLVSRKRFQCRLDKNDHIPPAKKRSLTLRDDCQEYTTEVHSKELTNVFEETGESHKGQDIFLTSGSTLTTPEPQRQQVEAAFQSRGSRSPDACMDKNVPQLPQDEMIVSDKEERTDAAPKSQQMDSRTSSSKASLSRPGRRPLGFLSLICSKNSLESDEPMQVHSKKRLKPLIPGLRKKLKRSNPFNESQEKNRESSDLLPSPSVITTQSENISSSATQVSCDQPLLKEGYKSAQKRAPQGEATTVSEYFFNDIFIEVDETE

SEQ ID NO: 8146 - protein, 2624 aa, Homo sapiens; identical to SEQ ID NO: 8137
  Payload ID: 1689;
  Gene Symbol: BDP1;
  Gene Name: B double prime 1, subunit of RNA polymerase III transcription initiation  factor IIIB;
  Uniprot ID:  A6H8Y1;
  ENSP ID: ENSP00000482469

SEQ ID NO: 8147 - protein, 583 aa, Homo sapiens; identical to SEQ ID NO: 8139
  Payload ID: 1689;
  Gene Symbol: BDP1;
  Gene Name: B double prime 1, subunit of RNA polymerase III transcription initiation  factor IIIB;
  ENSP ID: ENSP00000485731
  MOD_RES (1)..(1): Any amino acid

SEQ ID NO: 8148 - protein, 606 aa, Homo sapiens; identical to SEQ ID NO: 8140
  Payload ID: 1689;
  Gene Symbol: BDP1;
  Gene Name: B double prime 1, subunit of RNA polymerase III transcription initiation  factor IIIB;
  ENSP ID: ENSP00000487333

SEQ ID NO: 8149 - protein, 39 aa, Homo sapiens
  Payload ID: 1690;
  Gene Symbol:;
  Gene Name: B melanoma antigen family, member 5 [Source:EntrezGene;Acc:85316];
  ENSP ID: ENSP00000485185
MAAGAVFLALSAQLLQARLMKEESPVVSWRLEPEDGTAL

SEQ ID NO: 8150 - protein, 204 aa, Homo sapiens
  Payload ID: 1691;
  Gene Symbol: B9D1;
  Gene Name: B9 prt domain 1;
  Uniprot ID:  Q9UPM9;
  ENSP ID: ENSP00000261499
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREVTRVRSQGFVTLLFNVVTKDMRKLGYDTGPSDTQGVLGPSPPQSFPQ

SEQ ID NO: 8151 - protein, 153 aa, Homo sapiens
  Payload ID: 1691;
  Gene Symbol: B9D1;
  Gene Name: B9 prt domain 1;
  Uniprot ID:  Q9UPM9;
  ENSP ID: ENSP00000268841
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSLCLVASSDLQAAPPTEDK

SEQ ID NO: 8152 - protein, 161 aa, Homo sapiens
  Payload ID: 1691;
  Gene Symbol: B9D1;
  Gene Name: B9 prt domain 1;
  ENSP ID: ENSP00000378977
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREAQPG

SEQ ID NO: 8153 - protein, 187 aa, Homo sapiens
  Payload ID: 1691;
  Gene Symbol: B9D1;
  Gene Name: B9 prt domain 1;
  ENSP ID: ENSP00000378978
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREDENAEAEIPRSTWVSLCPSPAWLMLPFCPQ

SEQ ID NO: 8154 - protein, 133 aa, Homo sapiens
  Payload ID: 1691;
  Gene Symbol: B9D1;
  Gene Name: B9 prt domain 1;
  ENSP ID: ENSP00000410835
LLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTRSASCSTH

SEQ ID NO: 8155 - protein, 186 aa, Homo sapiens
  Payload ID: 1691;
  Gene Symbol: B9D1;
  Gene Name: B9 prt domain 1;
  ENSP ID: ENSP00000433359
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREAITAPRKAVFSVHGLTSPRALALVHIKGT

SEQ ID NO: 8156 - protein, 140 aa, Homo sapiens
  Payload ID: 1691;
  Gene Symbol: B9D1;
  Gene Name: B9 prt domain 1;
  ENSP ID: ENSP00000458525
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNCRSLQAGSWGGGPSTQTPRWWLRVKAGKVKLPPLS

SEQ ID NO: 8157 - protein, 147 aa, Homo sapiens
  Payload ID: 1691;
  Gene Symbol: B9D1;
  Gene Name: B9 prt domain 1;
  ENSP ID: ENSP00000459857
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNCRSLQAGSWGGGPSTQTPRWWLRVKAGKPPSGLSVKDSSVSR

SEQ ID NO: 8158 - protein, 213 aa, Homo sapiens
  Payload ID: 1691;
  Gene Symbol: B9D1;
  Gene Name: B9 prt domain 1;
  ENSP ID: ENSP00000460939
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNCRSLQAGSWGGGPSTQTPRWWLRVKAGKVKLPPLSYPHPPYRLQPGSGWAQGWGECRGPARHIGASPQMFPDEGLVGAQRVCHVCLSRQPLYLPVRGLGQALLSPFYR

SEQ ID NO: 8159 - protein, 106 aa, Homo sapiens
  Payload ID: 1691;
  Gene Symbol: B9D1;
  Gene Name: B9 prt domain 1;
  ENSP ID: ENSP00000462565
MMTSTASTALCTARTGPPQRVWRRGSHRSHPRAKMCGKHWCGTSPLMSPLKAPTPTAGHRSCSACMDQMCSGTMWFEAMGPCTCPSHLAGTKGPSPCLSQNLRLNC

SEQ ID NO: 8160 - protein, 112 aa, Homo sapiens
  Payload ID: 1691;
  Gene Symbol: B9D1;
  Gene Name: B9 prt domain 1;
  ENSP ID: ENSP00000463165
SNRARPRWVPPAPPDLPWRPRVLASFYSWSTGRWRAPSFQSMMTSTASTALCTARTGPPQRVWRRGSHRSHPRAKMCGKHWCGTSPLMSPLKAPTPTAAVQLAFWKFRVHQG

SEQ ID NO: 8161 - protein, 19 aa, Homo sapiens
  Payload ID: 1691;
  Gene Symbol: B9D1;
  Gene Name: B9 prt domain 1;
  ENSP ID: ENSP00000463255
MMTSTASTALCTARTGPPQ

SEQ ID NO: 8162 - protein, 175 aa, Homo sapiens
  Payload ID: 1692;
  Gene Symbol: B9D2;
  Gene Name: B9 prt domain 2;
  Uniprot ID:  Q9BPU9;
  ENSP ID: ENSP00000243578
MAEVHVIGQIIGASGFSESSLFCKWGIHTGAAWKLLSGVREGQTQVDTPQIGDMAYWSHPIDLHFATKGLQGWPRLHFQVWSQDSFGRCQLAGYGFCHVPSSPGTHQLACPTWRPLGSWREQLARAFVGGGPQLLHGDTIYSGADRYRLHTAAGGTVHLEIGLLLRNFDRYGVEC

SEQ ID NO: 8163 - protein, 82 aa, Homo sapiens
  Payload ID: 1692;
  Gene Symbol: B9D2;
  Gene Name: B9 prt domain 2;
  ENSP ID: ENSP00000469666
MAEVHVIGQIIGASGFSESSLFCKWGIHTETGSRYVAQAGLELLRSNRPPTSASQSARIKNGRHGSSCQACGRAKRKWTPRR

SEQ ID NO: 8164 - protein, 487 aa, Homo sapiens
  Payload ID: 1693;
  Gene Symbol: BPI;
  Gene Name: bactericidal/permeability-increasing prt;
  Uniprot ID:  P17213;
  ENSP ID: ENSP00000262865
MRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSELQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 8165 - protein, 95 aa, Homo sapiens
  Payload ID: 1693;
  Gene Symbol: BPI;
  Gene Name: bactericidal/permeability-increasing prt;
  ENSP ID: ENSP00000391511
MEKPGEDAARDGLLPLNPCWGGSRDGGSLCCPGWSQTPGPKPSSQSAGITSVSHHAKPDFKIFANPVDKTGDWKKGPEIQTQKPPPEATRQPGPL

SEQ ID NO: 8166 - protein, 123 aa, Homo sapiens
  Payload ID: 1693;
  Gene Symbol: BPI;
  Gene Name: bactericidal/permeability-increasing prt;
  ENSP ID: ENSP00000393126
MEKPGEDAARDGLLPLNPCWGGSRDGGSLCCPGWSQTPGPKPSSQSAGITSVSHHAKPDFKIFANPVAPWFNLKALRFWQLWRMRENMARGPCNAPRWASLMVLVAIGTAVTAAVNPGVVVRI

SEQ ID NO: 8167 - protein, 286 aa, Homo sapiens
  Payload ID: 1693;
  Gene Symbol: BPI;
  Gene Name: bactericidal/permeability-increasing prt;
  ENSP ID: ENSP00000409833
MENVCEKVTNSVSSELQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 8168 - protein, 55 aa, Homo sapiens
  Payload ID: 1693;
  Gene Symbol: BPI;
  Gene Name: bactericidal/permeability-increasing prt;
  ENSP ID: ENSP00000486976
MENVCEKVTNSVSSELQPYFQTLPVMTKIDSVAGINYGLVAPPATTAETLDVQMK

SEQ ID NO: 8169 - protein, 29 aa, Homo sapiens
  Payload ID: 1693;
  Gene Symbol: BPI;
  Gene Name: bactericidal/permeability-increasing prt;
  ENSP ID: ENSP00000487406
MEKPGEDAARDGLLPLNPCWGGSRCTMLL

SEQ ID NO: 8170 - protein, 618 aa, Homo sapiens
  Payload ID: 1694;
  Gene Symbol: BIRC2;
  Gene Name: baculoviral IAP repeat containing 2;
  Uniprot ID:  Q13490;
  ENSP ID: ENSP00000227758
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 8171 - protein, 569 aa, Homo sapiens
  Payload ID: 1694;
  Gene Symbol: BIRC2;
  Gene Name: baculoviral IAP repeat containing 2;
  Uniprot ID:  Q13490;
  ENSP ID: ENSP00000431723
MSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 8172 - protein, 79 aa, Homo sapiens
  Payload ID: 1694;
  Gene Symbol: BIRC2;
  Gene Name: baculoviral IAP repeat containing 2;
  ENSP ID: ENSP00000432410
MECNFVAVEDISSSRTNPYSYAMSTEEARFLTYHMWPLTFLSPSELARAGFYYIGPGDRVACFACGGKLSNWEPKDDAM

SEQ ID NO: 8173 - protein, 182 aa, Homo sapiens
  Payload ID: 1694;
  Gene Symbol: BIRC2;
  Gene Name: baculoviral IAP repeat containing 2;
  ENSP ID: ENSP00000433851
MKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAA

SEQ ID NO: 8174 - protein, 262 aa, Homo sapiens
  Payload ID: 1694;
  Gene Symbol: BIRC2;
  Gene Name: baculoviral IAP repeat containing 2;
  ENSP ID: ENSP00000434557
YDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGVSS

SEQ ID NO: 8175 - protein, 149 aa, Homo sapiens
  Payload ID: 1694;
  Gene Symbol: BIRC2;
  Gene Name: baculoviral IAP repeat containing 2;
  ENSP ID: ENSP00000434708
MEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDIS

SEQ ID NO: 8176 - protein, 597 aa, Homo sapiens
  Payload ID: 1694;
  Gene Symbol: BIRC2;
  Gene Name: baculoviral IAP repeat containing 2;
  ENSP ID: ENSP00000434979
MEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 8177 - protein, 139 aa, Homo sapiens
  Payload ID: 1694;
  Gene Symbol: BIRC2;
  Gene Name: baculoviral IAP repeat containing 2;
  ENSP ID: ENSP00000436741
MALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPI

SEQ ID NO: 8178 - protein, 618 aa, Homo sapiens; identical to SEQ ID NO: 8170
  Payload ID: 1694;
  Gene Symbol: BIRC2;
  Gene Name: baculoviral IAP repeat containing 2;
  Uniprot ID:  Q13490;
  ENSP ID: ENSP00000477613

SEQ ID NO: 8179 - protein, 534 aa, Homo sapiens [sequence omitted]

SEQ ID NO: 8180 - protein, 604 aa, Homo sapiens
  Payload ID: 1695;
  Gene Symbol: BIRC3;
  Gene Name: baculoviral IAP repeat containing 3;
  Uniprot ID:  Q13489;
  ENSP ID: ENSP00000263464
MNIVENSIFLSNLMKSANTFELKYDLSCELYRMSTYSTFPAGVPVSERSLARAGFYYTGVNDKVKCFCCGLMLDNWKRGDSPTEKHKKLYPSCRFVQSLNSVNNLEATSQPTFPSSVTNSTHSLLPGTENSGYFRGSYSNSPSNPVNSRANQDFSALMRSSYHCAMNNENARLLTFQTWPLTFLSPTDLAKAGFYYIGPGDRVACFACGGKLSNWEPKDNAMSEHLRHFPKCPFIENQLQDTSRYTVSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 8181 - protein, 183 aa, Homo sapiens
  Payload ID: 1695;
  Gene Symbol: BIRC3;
  Gene Name: baculoviral IAP repeat containing 3;
  ENSP ID: ENSP00000431718
QLQDTSRYTVSNLSMQTHAARFKTFFNWPSSVLVNPEQLASAGFYYVGNSDDVKCFCCDGGLRCWESGDDPWVQHAKWFPRWSLALLPRLECDGVMSAHCNLRLLGSGNSHASSLASSWDYRCEYLIRIKGQEFIRQVQASYPHLLEQLLSTSDSPGDENAESSIIHFEPGEDHSEDAIMMNT

SEQ ID NO: 8182 - protein, 604 aa, Homo sapiens; identical to SEQ ID NO: 8180
  Payload ID: 1695;
  Gene Symbol: BIRC3;
  Gene Name: baculoviral IAP repeat containing 3;
  Uniprot ID:  Q13489;
  ENSP ID: ENSP00000432907

SEQ ID NO: 8183 - protein, 604 aa, Homo sapiens; identical to SEQ ID NO: 8180
  Payload ID: 1695;
  Gene Symbol: BIRC3;
  Gene Name: baculoviral IAP repeat containing 3;
  Uniprot ID:  Q13489;
  ENSP ID: ENSP00000481903

SEQ ID NO: 8184 - protein, 165 aa, Homo sapiens
  Payload ID: 1696;
  Gene Symbol: BIRC5;
  Gene Name: baculoviral IAP repeat containing 5;
  ENSP ID: ENSP00000301633
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAEKVRRAIEQLAAMD

SEQ ID NO: 8185 - protein, 142 aa, Homo sapiens
  Payload ID: 1696;
  Gene Symbol: BIRC5;
  Gene Name: baculoviral IAP repeat containing 5;
  ENSP ID: ENSP00000324180
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAEKVRRAIEQLAAMD

SEQ ID NO: 8186 - protein, 137 aa, Homo sapiens
  Payload ID: 1696;
  Gene Symbol: BIRC5;
  Gene Name: baculoviral IAP repeat containing 5;
  Uniprot ID:  O15392;
  ENSP ID: ENSP00000364086
MGAPTLPPAWQPFLKDHRISTFKNWPFLEGCACTPERMAEAGFIHCPTENEPDLAQCFFCFKELEGWEPDDDPMQRKPTIRRKNLRKLRRKCAVPSSSWLPWIEASGRSCLVPEWLHHFQGLFPGATSLPVGPLAMS

SEQ ID NO: 8187 - protein, 74 aa, Homo sapiens
  Payload ID: 1696;
  Gene Symbol: BIRC5;
  Gene Name: baculoviral IAP repeat containing 5;
  Uniprot ID:  O15392;
  ENSP ID: ENSP00000465868
MGAPTLPPAWQPFLKDHRISTFKNWPFLEGCACTPERMAEAGFIHCPTENEPDLAQCFFCFKELEGWEPDDDPM

SEQ ID NO: 8188 - protein, 83 aa, Homo sapiens
  Payload ID: 1696;
  Gene Symbol: BIRC5;
  Gene Name: baculoviral IAP repeat containing 5;
  ENSP ID: ENSP00000466063
  MOD_RES (1)..(1): Any amino acid
XNWPFLEGCACTPERMAEAGFIHCPTENEPDLAQCFFCFKELEGWEPDDDPIGPGTVAYACNTSTLGGRGGRITRSGDRDHLG

SEQ ID NO: 8189 - protein, 78 aa, Homo sapiens
  Payload ID: 1696;
  Gene Symbol: BIRC5;
  Gene Name: baculoviral IAP repeat containing 5;
  Uniprot ID:  O15392;
  ENSP ID: ENSP00000466617
MGAPTLPPAWQPFLKDHRISTFKNWPFLEGCACTPERMAEAGFIHCPTENEPDLAQCFFCFKELEGWEPDDDPMRELC

SEQ ID NO: 8190 - protein, 121 aa, Homo sapiens
  Payload ID: 1696;
  Gene Symbol: BIRC5;
  Gene Name: baculoviral IAP repeat containing 5;
  ENSP ID: ENSP00000466675
  MOD_RES (1)..(1): Any amino acid
XNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIERALLAE

SEQ ID NO: 8191 - protein, 52 aa, Homo sapiens
  Payload ID: 1696;
  Gene Symbol: BIRC5;
  Gene Name: baculoviral IAP repeat containing 5;
  ENSP ID: ENSP00000467259
  MOD_RES (1)..(1): Any amino acid
XNWPFLEGCACTPERMAEAGFIHCPTENEPDLAQCFFCFKELEGWEPDDDPM

SEQ ID NO: 8192 - protein, 120 aa, Homo sapiens
  Payload ID: 1696;
  Gene Symbol: BIRC5;
  Gene Name: baculoviral IAP repeat containing 5;
  Uniprot ID:  O15392;
  ENSP ID: ENSP00000467336
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIERALLAE

SEQ ID NO: 8193 - protein, 110 aa, Homo sapiens
  Payload ID: 1697;
  Gene Symbol: BIRC6;
  Gene Name: baculoviral IAP repeat containing 6;
  ENSP ID: ENSP00000393590
  MOD_RES (1)..(1): Any amino acid
XEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKSATMCHVTVFRIS

SEQ ID NO: 8194 - protein, 4857 aa, Homo sapiens
  Payload ID: 1697;
  Gene Symbol: BIRC6;
  Gene Name: baculoviral IAP repeat containing 6;
  Uniprot ID:  Q9NR09;
  ENSP ID: ENSP00000393596
MVTGGGAAPPGTVTEPLPSVIVLSAGRKMAAAAAAASGPGCSSAAGAGAAGVSEWLVLRDGCMHCDADGLHSLSYHPALNAILAVTSRGTIKVIDGTSGATLQASALSAKPGGQVKCQYISAVDKVIFVDDYAVGCRKDLNGILLLDTALQTPVSKQDDVVQLELPVTEAQQLLSACLEKVDISSTEGYDLFITQLKDGLKNTSHETAANHKVAKWATVTFHLPHHVLKSIASAIVNELKKINQNVAALPVASSVMDRLSYLLPSARPELGVGPGRSVDRSLMYSEANRRETFTSWPHVGYRWAQPDPMAQAGFYHQPASSGDDRAMCFTCSVCLVCWEPTDEPWSEHERHSPNCPFVKGEHTQNVPLSVTLATSPAQFPCTDGTDRISCFGSGSCPHFLAAATKRGKICIWDVSKLMKVHLKFEINAYDPAIVQQLILSGDPSSGVDSRRPTLAWLEDSSSCSDIPKLEGDSDDLLEDSDSEEHSRSDSVTGHTSQKEAMEVSLDITALSILQQPEKLQWEIVANVLEDTVKDLEELGANPCLTNSKSEKTKEKHQEQHNIPFPCLLAGGLLTYKSPATSPISSNSHRSLDGLSRTQGESISEQGSTDNESCTNSELNSPLVRRTLPVLLLYSIKESDEKAGKIFSQMNNIMSKSLHDDGFTVPQIIEMELDSQEQLLLQDPPVTYIQQFADAAANLTSPDSEKWNSVFPKPGTLVQCLRLPKFAEEENLCIDSITPCADGIHLLVGLRTCPVESLSAINQVEALNNLNKLNSALCNRRKGELESNLAVVNGANISVIQHESPADVQTPLIIQPEQRNVSGGYLVLYKMNYATRIVTLEEEPIKIQHIKDPQDTITSLILLPPDILDNREDDCEEPIEDMQLTSKNGFEREKTSDISTLGHLVITTQGGYVKILDLSNFEILAKVEPPKKEGTEEQDTFVSVIYCSGTDRLCACTKGGELHFLQIGGTCDDIDEADILVDGSLSKGIEPSSEGSKPLSNPSSPGISGVDLLVDQPFTLEILTSLVELTRFETLTPRFSATVPPCWVEVQQEQQQRRHPQHLHQQHHGDAAQHTRTWKLQTDSNSWDEHVFELVLPKACMVGHVDFKFVLNSNITNIPQIQVTLLKNKAPGLGKVNALNIEVEQNGKPSLVDLNEEMQHMDVEESQCLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKEKSSNVKNENTSGTRKSENLRGCDLLQEVSVTIRRFKKTSISKERVQRCAMLQFSEFHEKLLNTLCRKTDDGQITEHAQSLVLDTLCWLAGVHSNGPGSSKEGNENLLSKTRKFLSDIVRVCFFEAGRSIAHKCARFLALCISNGKCDPCQPAFGPVLLKALLDNMSFLPAATTGGSVYWYFVLLNYVKDEDLAGCSTACASLLTAVSRQLQDRLTPMEALLQTRYGLYSSPFDPVLFDLEMSGSSCKNVYNSSIGVQSDEIDLSDVLSGNGKVSSCTAAEGSFTSLTGLLEVEPLHFTCVSTSDGTRIERDDAMSSFGVTPAVGGLSSGTVGEASTALSSAAQVALQSLSHAMASAEQQLQVLQEKQQQLLKLQQQKAKLEAKLHQTTAAAAAAASAVGPVHNSVPSNPVAAPGFFIHPSDVIPPTPKTTPLFMTPPLTPPNEAVSVVINAELAQLFPGSVIDPPAVNLAAHNKNSNKSRMNPLGSGLALAISHASHFLQPPPHQSIIIERMHSGARRFVTLDFGRPILLTDVLIPTCGDLASLSIDIWTLGEEVDGRRLVVATDISTHSLILHDLIPPPVCRFMKITVIGRYGSTNARAKIPLGFYYGHTYILPWESELKLMHDPLKGEGESANQPEIDQHLAMMVALQEDIQCRYNLACHRLETLLQSIDLPPLNSANNAQYFLRKPDKAVEEDSRVFSAYQDCIQLQLQLNLAHNAVQRLKVALGASRKMLSETSNPEDLIQTSSTEQLRTIIRYLLDTLLSLLHASNGHSVPAVLQSTFHAQACEELFKHLCISGTPKIRLHTGLLLVQLCGGERWWGQFLSNVLQELYNSEQLLIFPQDRVFMLLSCIGQRSLSNSGVLESLLNLLDNLLSPLQPQLPMHRRTEGVLDIPMISWVVMLVSRLLDYVATVEDEAAAAKKPLNGNQWSFINNNLHTQSLNRSSKGSSSLDRLYSRKIRKQLVHHKQQLNLLKAKQKALVEQMEKEKIQSNKGSSYKLLVEQAKLKQATSKHFKDLIRLRRTAEWSRSNLDTEVTTAKESPEIEPLPFTLAHERCISVVQKLVLFLLSMDFTCHADLLLFVCKVLARIANATRPTIHLCEIVNEPQLERLLLLLVGTDFNRGDISWGGAWAQYSLTCMLQDILAGELLAPVAAEAMEEGTVGDDVGATAGDSDDSLQQSSVQLLETIDEPLTHDITGAPPLSSLEKDKEIDLELLQDLMEVDIDPLDIDLEKDPLAAKVFKPISSTWYDYWGADYGTYNYNPYIGGLGIPVAKPPANTEKNGSQTVSVSVSQALDARLEVGLEQQAELMLKMMSTLEADSILQALTNTSPTLSQSPTGTDDSLLGGLQAANQTSQLIIQLSSVPMLNVCFNKLFSMLQVHHVQLESLLQLWLTLSLNSSSTGNKENGADIFLYNANRIPVISLNQASITSFLTVLAWYPNTLLRTWCLVLHSLTLMTNMQLNSGSSSAIGTQESTAHLLVSDPNLIHVLVKFLSGTSPHGTNQHSPQVGPTATQAMQEFLTRLQVHLSSTCPQIFSEFLLKLIHILSTERGAFQTGQGPLDAQVKLLEFTLEQNFEVVSVSTISAVIESVTFLVHHYITCSDKVMSRSGSDSSVGARACFGGLFANLIRPGDAKAVCGEMTRDQLMFDLLKLVNILVQLPLSGNREYSARVSVTTNTTDSVSDEEKVSGGKDGNGSSTSVQGSPAYVADLVLANQQIMSQILSALGLCNSSAMAMIIGASGLHLTKHENFHGGLDAISVGDGLFTILTTLSKKASTVHMMLQPILTYMACGYMGRQGSLATCQLSEPLLWFILRVLDTSDALKAFHDMGGVQLICNNMVTSTRAIVNTARSMVSTIMKFLDSGPNKAVDSTLKTRILASEPDNAEGIHNFAPLGTITSSSPTAQPAEVLLQATPPHRRARSAAWSYIFLPEEAWCDLTIHLPAAVLLKEIHIQPHLASLATCPSSVSVEVSADGVNMLPLSTPVVTSGLTYIKIQLVKAEVASAVCLRLHRPRDASTLGLSQIKLLGLTAFGTTSSATVNNPFLPSEDQVSKTSIGWLRLLHHCLTHISDLEGMMASAAAPTANLLQTCAALLMSPYCGMHSPNIEVVLVKIGLQSTRIGLKLIDILLRNCAASGSDPTDLNSPLLFGRLNGLSSDSTIDILYQLGTTQDPGTKDRIQALLKWVSDSARVAAMKRSGRMNYMCPNSSTVEYGLLMPSPSHLHCVAAILWHSYELLVEYDLPALLDQELFELLFNWSMSLPCNMVLKKAVDSLLCSMCHVHPNYFSLLMGWMGITPPPVQCHHRLSMTDDSKKQDLSSSLTDDSKNAQAPLALTESHLATLASSSQSPEAIKQLLDSGLPSLLVRSLASFCFSHISSSESIAQSIDISQDKLRRHHVPQQCNKMPITADLVAPILRFLTEVGNSHIMKDWLGGSEVNPLWTALLFLLCHSGSTSGSHNLGAQQTSARSASLSSAATTGLTTQQRTAIENATVAFFLQCISCHPNNQKLMAQVLCELFQTSPQRGNLPTSGNISGFIRRLFLQLMLEDEKVTMFLQSPCPLYKGRINATSHVIQHPMYGAGHKFRTLHLPVSTTLSDVLDRVSDTPSITAKLISEQKDDKEKKNHEEKEKVKAENGFQDNYSVVVASGLKSQSKRAVSATPPRPPSRRGRTIPDKIGSTSGAEAANKIITVPVFHLFHKLLAGQPLPAEMTLAQLLTLLYDRKLPQGYRSIDLTVKLGSRVITDPSLSKTDSYKRLHPEKDHGDLLASCPEDEALTPGDECMDGILDESLLETCPIQSPLQVFAGMGGLALIAERLPMLYPEVIQQVSAPVVTSTTQEKPKDSDQFEWVTIEQSGELVYEAPETVAAEPPPIKSAVQTMSPIPAHSLAAFGLFLRLPGYAEVLLKERKHAQCLLRLVLGVTDDGEGSHILQSPSANVLPTLPFHVLRSLFSTTPLTTDDGVLLRRMALEIGALHLILVCLSALSHHSPRVPNSSVNQTEPQVSSSHNPTSTEEQQLYWAKGTGFGTGSTASGWDVEQALTKQRLEEEHVTCLLQVLASYINPVSSAVNGEAQSSHETRGQNSNALPSVLLELLSQSCLIPAMSSYLRNDSVLDMARHVPLYRALLELLRAIASCAAMVPLLLPLSTENGEEEEEQSECQTSVGTLLAKMKTCVDTYTNRLRSKRENVKTGVKPDASDQEPEGLTLLVPDIQKTAEIVYAATTSLRQANQEKKLGEYSKKAAMKPKPLSVLKSLEEKYVAVMKKLQFDTFEMVSEDEDGKLGFKVNYHYMSQVKNANDANSAARARRLAQEAVTLSTSLPLSSSSSVFVRCDEERLDIMKVLITGPADTPYANGCFEFDVYFPQDYPSSPPLVNLETTGGHSVRFNPNLYNDGKVCLSILNTWHGRPEEKWNPQTSSFLQVLVSVQSLILVAEPYFNEPGYERSRGTPSGTQSSREYDGNIRQATVKWAMLEQIRNPSPCFKEVIHKHFYLKRVEIMAQCEEWIADIQQYSSDKRVGRTMSHHAAALKRHTAQLREELLKLPCPEGLDPDTDDAPEVCRATTGAEETLMHDQVKPSSSKELPSDFQL

SEQ ID NO: 8195 - protein, 191 aa, Homo sapiens
  Payload ID: 1697;
  Gene Symbol: BIRC6;
  Gene Name: baculoviral IAP repeat containing 6;
  ENSP ID: ENSP00000413090
SWDEHVFELVLPKACMVGHVDFKFVLNSNITNIPQIQVTLLKNKAPGLGKVNGLRLCPFLEDHKEDILCGPVWLASGLDLSGHAGMLTLTSPKLVKGMAGGKYRSFLIHVKAVNERGTEEICNGGMRPVVRLPSLKHQSNKGYSLASLLAKVAAGKEKSSNVKNENTSGTRKSENLRGCDLLQEVSVTIRR

SEQ ID NO: 8196 - protein, 298 aa, Homo sapiens
  Payload ID: 1698;
  Gene Symbol: BIRC7;
  Gene Name: baculoviral IAP repeat containing 7;
  Uniprot ID:  Q96CA5;
  ENSP ID: ENSP00000217169
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 8197 - protein, 280 aa, Homo sapiens
  Payload ID: 1698;
  Gene Symbol: BIRC7;
  Gene Name: baculoviral IAP repeat containing 7;
  Uniprot ID:  Q96CA5;
  ENSP ID: ENSP00000345213
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGARDVEAQLRRLQEERTCKVCLDRAVSIVFVPCGHLVCAECAPGLQLCPICRAPVRSRVRTFLS

SEQ ID NO: 8198 - protein, 193 aa, Homo sapiens
  Payload ID: 1698;
  Gene Symbol: BIRC7;
  Gene Name: baculoviral IAP repeat containing 7;
  ENSP ID: ENSP00000378717
MPLPWDYPEAPWRRLHSSPPRPCPRALQGGGRRGPNPDPRGSKGLKQTVGALNPNLHLWGICSCQFLLRSKGRDFVHSVQETHSQLLGSWDPWEEPEDAAPVAPSVPASGYPELPTPRREVQSESAQEPGARDVEAQLRRLQEERTCKVCLDRAVSIVFVPCGHLVCAECAPGLQLCPICRAPVRSRVRTFLS

SEQ ID NO: 8199 - protein, 236 aa, Homo sapiens
  Payload ID: 1699;
  Gene Symbol: BIRC8;
  Gene Name: baculoviral IAP repeat containing 8;
  Uniprot ID:  Q96P09;
  ENSP ID: ENSP00000412957
MTGYEARLITFGTWMYSVNKEQLARAGFYAIGQEDKVQCFHCGGGLANWKPKEDPWEQHAKWYPGCKYLLEEKGHEYINNIHLTRSLEGALVQTTKKTPSLTKRISDTIFPNPMLQEAIRMGFDFKDVKKIMEERIQTSGSNYKTLEVLVADLVSAQKDTTENELNQTSLQREISPEEPLRRLQEEKLCKICMDRHIAVVFIPCGHLVTCKQCAEAVDRCPMCSAVIDFKQRVFMS

SEQ ID NO: 8200 - protein, 2608 aa, Homo sapiens
  Payload ID: 1700;
  Gene Symbol: BAHCC1;
  Gene Name: BAH domain and coiled-coil containing 1;
  ENSP ID: ENSP00000303486
MDGRDFAPPPHLLSERGSLGHRSAAAAARLAPAGPAAQPPAHFQPGKYFPSPLPMASHTASSRLMGSSPASSFMGSFLTSSLGSAASTHPSGPSSSPPEQAYRGSHPTTSQIWFSHSHEAPGYPRFSGSLASTFLPVSHLDHHGNSNVLYGQHRFYGTQKDNFYLRNLPPQPTLLPANHNFPSVARAAPAHPMGSCSRDRDRGEAGSLQKGPKDFDRFLVGKELGREKAGKAAEGKERPAAEEDGGKERHKLVLPVPADGHCREGGPAPRGACEGRPKHLTSCLLNTKVLNGEMGRAALASCAGGMLGRPGTGVVTSGRCAKEAAGPPEPGPAFSECLERRQMLHHTASYAGPPPPLSTAAGSFPCLQLHGGPDGLCPLQDKAPRDLKASGPTFVPSVGHLADKGRPFQAAEACAVAGEGKDRHLEGTMAPDHAAPYGVSYAHLKAEGKGERRPGGFEAALNPRLKGLDYLSSAGPEASFPGLPKSGLDKSGYFELPTSSQDCARPGHQDPLGGKAPQACCTLDKTVGKEAPAGPPGAQKVARIRHQQHLMAAEVEQGGIGAEAKRKSLELASLGYSGPHLPPWGVQAGQGTAMAISEERKAGAYLDPFGSGLQQAALLPQELPAPPDEVSAMKNLLKYSSQALVVGQKAPLVGLGGLKASCIQQEAKFLSSKGPGQSERPDCARSREHDTTHGDGEVRQPPVGIAVALARQKDTVSRSEAAYGTNTARQGRAAPAFKGGGGPRSTHALDLEAEEERTRLCDDRLGLASRELLLQDSKDRVEFARIHPPSSCPGDLAPHLMMQSGQLGGDPAPHTHPHPPWLPRTRSPSLWMGGHSYGLGHPALHQNLPPGFPASVAGPVPSVFPLPQDAPTQLVILPSEPTPHSAPHALADVMDQASLWPPMYGGRGPASHMQHPGQLPVYSRPQLLRQQELYALQQQRAAQFQRKPEDQHLDLEEPAQEKAPKSTHKPVALTPTAPGAPSPAAGPTKLPPCCHPPDPKPPASSPTPPPRPSAPCTLNVCPASSPGPGSRVRSAEEKNGEGQQSTADIITSEPDLPPGYLRPMAGLGFSLPSDVHSSNLEDPETMQTTAPGAQPEPTRTFLPGEPPPCSPRSLEEPGLLSGAREATQDLAATPYPTERGPQGKAADPSPLEGLQELQCAALLEAGGPEATGQAHSTQGGAREERSREEGEQGPSSGASSQVLEQRAGSPGALEDEGEQPAPEEDELEEDELGQQSMEDSEEDCGGAPDNSHPPRALPGLDALVAATINLGDLPSDSPPDPQPPAASGPPSTVPLPHSSGIHGIALLSELADLAIQRQRSERTVPEEEEDVLAFNLQHLATLATAWSLVEAAGLDSSTAPAQPPTANPCSGPRLTPRMQILQRKDTWTPKTKPVCPLKAAIDRLDTQEVGMRVRLAELQRRYKEKQRELARLQRKHDHERDESSRSPARRGPGRPRKRKHSSSLPAPRPTGPLPRSDGKKVKAVRTSLGLLCAELRGGSGGEPAKKRSKLERSVYAGLQTASVEKAQCKKSSCQGGLAPSVAHRVAQLKPKVKSKGLPTGLSSFQQKEATPGGRIREKLSRAKSAKVSGATRHPQPKGHGSRETPRCPAQPSVAASQEAGSGYDSEDCEGLLGTEAPPREAGLLLHTGASVAVLGPSPSSVVKMEANQKAKKKKERQGLLGACRLSSPESEVKIKRRSVKAKVGTTLERAPGQRPPGALGKKKAKGKAKGSLRAEPGATPSRDALFNPSRAFACREEGSQLASERLKRATRKGTVLQPVLRRKNGALSITLATRNAKAILGKGRKLSKVKHKAGKQGKGRAVSRLLESFAVEEDFEFDDNSSFSEEEEDEEEEEEDSGPLSAEQSAALARSCAIHKEDLRDGLPVLIPKEDSLLYAGSVRTLQPPDIYSIVIEGERGNRQRIYSLEQLLQEAVLDVRPQSSRYLPPGTRVCAYWSQKSRCLYPGNVVRGASGDEDEDLDSVVVEFDDGDTGHIAVSNVRLLPPDFKIQCTEPSPALLVSSSCRRTKKVSSEAPPPSEAATPSLSPKAQDGPEALKTPGKKSISKDKAGKAELLTSGAKSPTGASDHFLGRRGSPLLSWSAVAQTKRKAVAAASKGPGVLQNLFQLNGSSKKLRAREALFPVHSVATPIFGNGFRADSFSSLASSYAPFVGGTGPGLPRGAHKLLRAKKAERVEAEKGGRRRAGGEFLVKLDHEGVTSPKNKTCKALLMGDKDFSPKLGRPLPSPSYVHPALVGKDKKGRAPIPPLPMGLALRKYAGQAEFPLPYDSDCHSSFSDEDEDGPGLAAGVPSRFLARLSVSSSSSGSSTSSSSGSVSTSSLCSSDNEDSSYSSDDEDPALLLQTCLTHPVPTLLAQPEALRSKGSGPHAHAQRCFLSRATVAGTGAGSGPSSSSKSKLKRKEALSFSKAKELSRRQRPPSVENRPKISAFLPARQLWKWSGNPTQRRGMKGKARKLFYKAIVRGEETLRVGDCAVFLSAGRPNLPYIGRIESMWESWGSNMVVKVKWFYHPEETKLGKRQCDGKNALYQSCHEDENDVQTISHKCQVVAREQYEQMARSRKCQDRQDLYYLAGTYDPTTGRLVTADGVPILC

SEQ ID NO: 8201 - protein, 2639 aa, Homo sapiens
  Payload ID: 1700;
  Gene Symbol: BAHCC1;
  Gene Name: BAH domain and coiled-coil containing 1;
  ENSP ID: ENSP00000462154
MDGRDFAPPPHLLSERGSLGHRSAAAAARLAPAGPAAQPPAHFQPGKYFPSPLPMASHTASSRLMGSSPASSFMGSFLTSSLGSAASTHPSGPSSSPPEQAYRGSHPTTSQIWFSHSHEAPGYPRFSGSLASTFLPVSHLDHHGNSNVLYGQHRFYGTQKDNFYLRNLPPQPTLLPANHNFPSVARAAPAHPMGSCSRDRDRGEAGSLQKGPKDFDRFLVGKELGREKAGKAAEGKERPAAEEDGGKERHKLVLPVPADGHCREGGPAPRGACEGRPKHLTSCLLNTKVLNGEMGRAALASCAGGMLGRPGTGVVTSGRCAKEAAGPPEPGPAFSECLERRQMLHHTASYAGPPPPLSTAAGSFPCLQLHGGPDGLCPLQDKAPRDLKASGPTFVPSVGHLADKGRPFQAAEACAVAGEGKDRHLEGTMAPDHAAPYGVSYAHLKAEGKGERRPGGFEAALNPRLKGLDYLSSAGPEASFPGLPKSGLDKSGYFELPTSSQDCARPGHQDPLGGKAPQACCTLDKTVGKEAPAGPPGAQKVARIRHQQHLMAAEVEQGGIGAEAKRKSLELASLGYSGPHLPPWGVQAGQGTAMAISEERKAGAYLDPFGSGLQQAALLPQELPAPPDEVSAMKNLLKYSSQALVVGQKAPLVGLGGLKASCIQQEAKFLSSKGPGQSERPDCARSREHDTTHGDGEVRQPPVGIAVALARQKDTVSRSEAAYGTNTARQGRAAPAFKGGGGPRSTHALDLEAEEERTRLCDDRLGLASRELLLQDSKDRVEFARIHPPSSCPGDLAPHLMMQSGQLGGDPAPHTHPHPPWLPRTRSPSLWMGGHSYGLGHPALHQNLPPGFPASVAGPVPSVFPLPQDAPTQLVILPSEPTPHSAPHALADVMDQASLWPPMYGGRGPASHMQHPGQLPVYSRPQLLRQQELYALQQQRAAQFQRKPEDQHLDLEEPAQEKAPKSTHKPVALTPTAPGAPSPAAGPTKLPPCCHPPDPKPPASSPTPPPRPSAPCTLNVCPASSPGPGSRVRSAEEKNGEGQQSTADIITSEPVARAHSVAHAGLEFLASNDPSTSASQSFGITDLPPGYLRPMAGLGFSLPSDVHSSNLEDPETMQTTAPGAQPEPTRTFLPGEPPPCSPRSLEEPGLLSGAREATQDLAATPYPTERGPQGKAADPSPLEGLQELQCAALLEAGGPEATGQAHSTQGGAREERSREEGEQGPSSGASSQVLEQRAGSPGALEDEGEQPAPEEDELEEDELGQQSMEDSEEDCGGAPDNSHPPRALPGLDALVAATINLGDLPSDSPPDPQPPAASGPPSTVPLPHSSGIHGIALLSELADLAIQRQRSERTVPEEEEDVLAFNLQHLATLATAWSLVEAAGLDSSTAPAQPPTANPCSGPRLTPRMQILQRKDTWTPKTKPVCPLKAAIDRLDTQEVGMRVRLAELQRRYKEKQRELARLQRKHDHERDESSRSPARRGPGRPRKRKHSSSLPAPRPTGPLPRSDGKKVKAVRTSLGLLCAELRGGSGGEPAKKRSKLERSVYAGLQTASVEKAQCKKSSCQGGLAPSVAHRVAQLKPKVKSKGLPTGLSSFQQKEATPGGRIREKLSRAKSAKVSGATRHPQPKGHGSRETPRCPAQPSVAASQEAGSGYDSEDCEGLLGTEAPPREAGLLLHTGASVAVLGPSPSSVVKMEANQKAKKKKERQGLLGACRLSSPESEVKIKRRSVKAKVGTTLERAPGQRPPGALGKKKAKGKAKGSLRAEPGATPSRDALFNPSRAFACREEGSQLASERLKRATRKGTVLQPVLRRKNGALSITLATRNAKAILGKGRKLSKVKHKAGKQGKGRAVSRLLESFAVEEDFEFDDNSSFSEEEEDEEEEEEDSGPLSAEQSAALARSCAIHKEDLRDGLPVLIPKEDSLLYAGSVRTLQPPDIYSIVIEGERGNRQRIYSLEQLLQEAVLDVRPQSSRYLPPGTRVCAYWSQKSRCLYPGNVVRGASGDEDEDLDSVVVEFDDGDTGHIAVSNVRLLPPDFKIQCTEPSPALLVSSSCRRTKKVSSEAPPPSEAATPSLSPKAQDGPEALKTPGKKSISKDKAGKAELLTSGAKSPTGASDHFLGRRGSPLLSWSAVAQTKRKAVAAASKGPGVLQNLFQLNGSSKKLRAREALFPVHSVATPIFGNGFRADSFSSLASSYAPFVGGTGPGLPRGAHKLLRAKKAERVEAEKGGRRRAGGEFLVKLDHEGVTSPKNKTCKALLMGDKDFSPKLGRPLPSPSYVHPALVGKDKKGRAPIPPLPMGLALRKYAGQAEFPLPYDSDCHSSFSDEDEDGPGLAAGVPSRFLARLSVSSSSSGSSTSSSSGSVSTSSLCSSDNEDSSYSSDDEDPALLLQTCLTHPVPTLLAQPEALRSKGSGPHAHAQRCFLSRATVAGTGAGSGPSSSSKSKLKRKEALSFSKAKELSRRQRPPSVENRPKISAFLPARQLWKWSGNPTQRRGMKGKARKLFYKAIVRGEETLRVGDCAVFLSAGRPNLPYIGRIESMWESWGSNMVVKVKWFYHPEETKLGKRQCDGKNALYQSCHEDENDVQTISHKCQVVAREQYEQMARSRKCQDRQDLYYLAGTYDPTTGRLVTADGVPILC

SEQ ID NO: 8202 - protein, 521 aa, Homo sapiens
  Payload ID: 1701;
  Gene Symbol: BAIAP2;
  Gene Name: BAI1-associated prt 2;
  Uniprot ID:  Q9UQB8;
  ENSP ID: ENSP00000315685
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 8203 - protein, 552 aa, Homo sapiens
  Payload ID: 1701;
  Gene Symbol: BAIAP2;
  Gene Name: BAI1-associated prt 2;
  Uniprot ID:  Q9UQB8;
  ENSP ID: ENSP00000316338
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRCDLSAQGPEGREHGDGSARTLAGR

SEQ ID NO: 8204 - protein, 375 aa, Homo sapiens
  Payload ID: 1701;
  Gene Symbol: BAIAP2;
  Gene Name: BAI1-associated prt 2;
  ENSP ID: ENSP00000391837
MLLPEGQRQRALGFGTVTSTYSPVGQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSR

SEQ ID NO: 8205 - protein, 534 aa, Homo sapiens
  Payload ID: 1701;
  Gene Symbol: BAIAP2;
  Gene Name: BAI1-associated prt 2;
  Uniprot ID:  Q9UQB8;
  ENSP ID: ENSP00000401022
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRSAPLLS

SEQ ID NO: 8206 - protein, 520 aa, Homo sapiens
  Payload ID: 1701;
  Gene Symbol: BAIAP2;
  Gene Name: BAI1-associated prt 2;
  Uniprot ID:  Q9UQB8;
  ENSP ID: ENSP00000413069
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSADVEVARF

SEQ ID NO: 8207 - protein, 140 aa, Homo sapiens
  Payload ID: 1701;
  Gene Symbol: BAIAP2;
  Gene Name: BAI1-associated prt 2;
  ENSP ID: ENSP00000458202
MEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDK

SEQ ID NO: 8208 - protein, 130 aa, Homo sapiens
  Payload ID: 1701;
  Gene Symbol: BAIAP2;
  Gene Name: BAI1-associated prt 2;
  ENSP ID: ENSP00000458440
MQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLER

SEQ ID NO: 8209 - protein, 79 aa, Homo sapiens
  Payload ID: 1701;
  Gene Symbol: BAIAP2;
  Gene Name: BAI1-associated prt 2;
  ENSP ID: ENSP00000458494
MGELASESQGSKELGDVLFQMAEVHRQIQNQLEEMLKSFHNELLTQLEQKVELDSRYLSAALKKYQTEQRSKGDALDKC

SEQ ID NO: 8210 - protein, 135 aa, Homo sapiens
  Payload ID: 1701;
  Gene Symbol: BAIAP2;
  Gene Name: BAI1-associated prt 2;
  ENSP ID: ENSP00000458522
MGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRR

SEQ ID NO: 8211 - protein, 180 aa, Homo sapiens
  Payload ID: 1701;
  Gene Symbol: BAIAP2;
  Gene Name: BAI1-associated prt 2;
  ENSP ID: ENSP00000458735
MGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPE

SEQ ID NO: 8212 - protein, 512 aa, Homo sapiens
  Payload ID: 1701;
  Gene Symbol: BAIAP2;
  Gene Name: BAI1-associated prt 2;
  Uniprot ID:  Q9UQB8;
  ENSP ID: ENSP00000458964
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSR

SEQ ID NO: 8213 - protein, 58 aa, Homo sapiens
  Payload ID: 1701;
  Gene Symbol: BAIAP2;
  Gene Name: BAI1-associated prt 2;
  ENSP ID: ENSP00000459730
MGELASESQGSKELGDVLFQMAEVHRQIQNQLEEMLKSFHNELLTQLEQKVELDSRLR

SEQ ID NO: 8214 - protein, 234 aa, Homo sapiens
  Payload ID: 1701;
  Gene Symbol: BAIAP2;
  Gene Name: BAI1-associated prt 2;
  ENSP ID: ENSP00000459787
MGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSA

SEQ ID NO: 8215 - protein, 175 aa, Homo sapiens
  Payload ID: 1701;
  Gene Symbol: BAIAP2;
  Gene Name: BAI1-associated prt 2;
  ENSP ID: ENSP00000460131
MEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFC

SEQ ID NO: 8216 - protein, 106 aa, Homo sapiens
  Payload ID: 1701;
  Gene Symbol: BAIAP2;
  Gene Name: BAI1-associated prt 2;
  ENSP ID: ENSP00000460344
MSLSRSEEMHRLTENVYKTIMEQFNPSLRNFIAMGKNYEKALAGVTYAAKGYFDALVKMGELASESQGSKELGDVLFQMAEVHRQIQNQLEEMPCPASCSGSMCWS

SEQ ID NO: 8217 - protein, 216 aa, Homo sapiens
  Payload ID: 1701;
  Gene Symbol: BAIAP2;
  Gene Name: BAI1-associated prt 2;
  ENSP ID: ENSP00000460350
  MOD_RES (1)..(1): Any amino acid
XPKSLSPPQSQSKLSDSYSNTLPVRKSVTPKNSYATTAENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRSAPLLS

SEQ ID NO: 8218 - protein, 149 aa, Homo sapiens
  Payload ID: 1701;
  Gene Symbol: BAIAP2;
  Gene Name: BAI1-associated prt 2;
  ENSP ID: ENSP00000460492
MSLSRSEEMHRLTENVYKRVEEKYQRNLFPIFSPSALKPESRNFRGESWQGTIMEQFNPSLRNFIAMGKNYEKALAGVTYAAKGYFDALVKMGELASESQGSKELGDVLFQMAEVHRQIQNQLEEMLKSFHNELLTQLEQKVELDSRLR

SEQ ID NO: 8219 - protein, 97 aa, Homo sapiens
  Payload ID: 1701;
  Gene Symbol: BAIAP2;
  Gene Name: BAI1-associated prt 2;
  ENSP ID: ENSP00000461101
QTEQRSKGDALDKCQAELKKLRKKSQGSKNPQKYSDKELQYIDAISNKQGELENYVSDGYKTALTEERRRFCFLVEKQCAVAKNSAAYHSKGGPGPV

SEQ ID NO: 8220 - protein, 553 aa, Homo sapiens
  Payload ID: 1701;
  Gene Symbol: BAIAP2;
  Gene Name: BAI1-associated prt 2;
  ENSP ID: ENSP00000461144
MSLSRSEEMHRLTENVYKRVEEKYQRNLFPIFSPSALKPESRNFRGESWQGTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSADVEVARF

SEQ ID NO: 8221 - protein, 114 aa, Homo sapiens
  Payload ID: 1701;
  Gene Symbol: BAIAP2;
  Gene Name: BAI1-associated prt 2;
  ENSP ID: ENSP00000461736
MGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQ

SEQ ID NO: 8222 - protein, 511 aa, Homo sapiens
  Payload ID: 1702;
  Gene Symbol: BAIAP2L1;
  Gene Name: BAI1-associated prt 2-like 1;
  Uniprot ID:  Q9UHR4;
  ENSP ID: ENSP00000005260
MSRGPEEVNRLTESTYRNVMEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVRKDYDTLSKCSPKMPPAPSGRAYTSPLIDMFNNPATAAPNSQRVNNSTGTSEDPSLQRSVSVATGLNMMKKQKVKTIFPHTAGSNKTLLSFAQGDVITLLIPEEKDGWLYGEHDVSKARGWFPSSYTKLLEENETEAVTVPTPSPTPVRSISTVNLSENSSVVIPPPDYLECLSMGAAADRRADSARTTSTFKAPASKPETAAPNDANGTAKPPFLSGENPFATVKLRPTVTNDRSAPIIR

SEQ ID NO: 8223 - protein, 515 aa, Homo sapiens
  Payload ID: 1703;
  Gene Symbol: BAIAP2L2;
  Gene Name: BAI1-associated prt 2-like 2;
  Uniprot ID:  Q6UXY1;
  ENSP ID: ENSP00000328876
MAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRARGMLQNRVLLWKEQSEASRSPSRAHSPGLLGPALGPPYPSGRLTPTCLDMPPRPLGEFSSPRSRHGSGSYGTEPDARPASQLEPDRRSLPRTPSASSLYSGSAQSSRSNSFGERPGGGGGARRVRALVSHSEGANHTLLRFSAGDVVEVLVPEAQNGWLYGKLEGSSASGWFPEAYVKALEEGPVNPMTPVTPMTSMTSMSPMTPMNPGNELPSRSYPLRGSHSLDDLLDRPGNSTPSRVPSRAPSPAPPPLPSSRRSSMGSTAVATDVKKLMSSEQYPPQELFPRGTNPFATVKLRPTITNDRSAPLIR

SEQ ID NO: 8224 - protein, 529 aa, Homo sapiens
  Payload ID: 1703;
  Gene Symbol: BAIAP2L2;
  Gene Name: BAI1-associated prt 2-like 2;
  Uniprot ID:  Q6UXY1;
  ENSP ID: ENSP00000371085
MAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRARGMLQNRVLLWKEQSEASRSPSRAHSPGLLGPALGPPYPSGRLTPTCLDMPPRPLGEFSSPRSRHGSGSYGTEPDARPASQLEPDRRSLPRTPSASSLYSGSAQSSRSNSFGERPGGGGGARRVRALVSHSEGANHTLLRFSAGDVVEVLVPEAQNGWLYGKLEGSSASGWFPEAYVKALEEGPVNPMTPVTPMTSMTSMSPMTPMNPGNELPSRSYPLRGSHSLDDLLDRPGNSIAPSEYWDGQSRSRTPSRVPSRAPSPAPPPLPSSRRSSMGSTAVATDVKKLMSSEQYPPQELFPRGTNPFATVKLRPTITNDRSAPLIR

SEQ ID NO: 8225 - protein, 196 aa, Homo sapiens
  Payload ID: 1703;
  Gene Symbol: BAIAP2L2;
  Gene Name: BAI1-associated prt 2-like 2;
  ENSP ID: ENSP00000410074
SSRSNSFGERPGGGGGARRVRALVSHSEGANHTLLRFSAGDVVEVLVPEAQNGWLYGKLEGSSASGWFPEAYVKALEEGPVNPMTPVTPMTSMTSMSPMTPMNPGNELPSRSYPLRGSHSLDDLLDRPGNSIAPSEYWDGQSRSRTPSRVPSRAPSPAPPPLPSSRRSSMGSTAVATDVKGHKSFCHCQASSHHHQ

SEQ ID NO: 8226 - protein, 1187 aa, Homo sapiens
  Payload ID: 1704;
  Gene Symbol: BAIAP3;
  Gene Name: BAI1-associated prt 3;
  Uniprot ID:  O94812;
  ENSP ID: ENSP00000324510
MRPRGAAFAAGPPGDLHLGTAIGFAGAIWRSRSPAMSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 8227 - protein, 1169 aa, Homo sapiens
  Payload ID: 1704;
  Gene Symbol: BAIAP3;
  Gene Name: BAI1-associated prt 3;
  Uniprot ID:  O94812;
  ENSP ID: ENSP00000380625
MSTLLDIKSSVLRQVQVCPSFRRRTEQDPGSASADPQEPATGAWKPGDGVEFFAHMRLMLKKGEGRQGLPCLEAWGSPCRQSPHPGPHTQVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 8228 - protein, 1152 aa, Homo sapiens
  Payload ID: 1704;
  Gene Symbol: BAIAP3;
  Gene Name: BAI1-associated prt 3;
  Uniprot ID:  O94812;
  ENSP ID: ENSP00000407242
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 8229 - protein, 1116 aa, Homo sapiens
  Payload ID: 1704;
  Gene Symbol: BAIAP3;
  Gene Name: BAI1-associated prt 3;
  Uniprot ID:  O94812;
  ENSP ID: ENSP00000409533
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVEMLYEEALYTVLYRAGTMGPDQVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVRRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 8230 - protein, 191 aa, Homo sapiens
  Payload ID: 1704;
  Gene Symbol: BAIAP3;
  Gene Name: BAI1-associated prt 3;
  ENSP ID: ENSP00000455414
  MOD_RES (1)..(1): Any amino acid
XYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSSRFHFTLEALVSFFHAEGQGLPLESLRDGSYKRLKEELRLHKCSTRECIEQFYL

SEQ ID NO: 8231 - protein, 1124 aa, Homo sapiens
  Payload ID: 1704;
  Gene Symbol: BAIAP3;
  Gene Name: BAI1-associated prt 3;
  Uniprot ID:  O94812;
  ENSP ID: ENSP00000457644
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 8232 - protein, 217 aa, Homo sapiens
  Payload ID: 1704;
  Gene Symbol: BAIAP3;
  Gene Name: BAI1-associated prt 3;
  ENSP ID: ENSP00000457947
  MOD_RES (1)..(1): Any amino acid
XYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQAHLCPSCL

SEQ ID NO: 8233 - protein, 1129 aa, Homo sapiens
  Payload ID: 1704;
  Gene Symbol: BAIAP3;
  Gene Name: BAI1-associated prt 3;
  Uniprot ID:  O94812;
  ENSP ID: ENSP00000458134
MSTLLDIKSSVLRQVQVCPSFRRRTEQDPGSASADPQEPATGAWKPGDGVEFFAHMRLMLKKGEGRQGLPCLEVPLRSGSPAPPEPVDPSLGLRALAPEEVDDEEALLSYLQQVFGTSLEEHTEAIERVRKAKAPTYALKVSVMRAKNLLAKDPNGFSDPYCMLGILPASDATREPRAQKEQRFGFRKGSKRGGPLPAKCIQVTEVKSSTLNPVWKEHFLFEIEDVSTDQLHLDIWDHDDDVSLVEACRKLNEVIGLKGMGRYFKQIVKSARANGTAGPTEDHTDDFLGCLNIPVREVPVAGVDRWFKLEPRSSASRVQGHCHLVLKLITTQRDTAMSQRGRSGFLSHLLLLSHLLRLEHSAEEPNSSSWRGELSTPAATILCLHGAQSNLSPLQLAVLHWQVSSRHHQTCTLDYSYLLGLLEDMQAHWEEAPSLPQEQEESLADSLSAFSEFGLQLLRQLRDYFPATNSTAVHRLELLLKCLGKLQLFQPSFEICPFESELNMDIAAALKRGNREWYDRILNDKSPREQPGPQRLPGLVVLADAVYDDLQFCYSVYASLFHSILNVDVFTLTFRQLERLVAEEAWVLTEELSPKMTLEVASGLFELYLTLADLQRFWDSIPGRDSRSLALAGIHAPFLPAVKLWFQVLRDQAKWRLQGAVDMDTLEPVDASSRHSSSAATAGLCLSHIQELWVRLAWPDPAQAQGLGTQLGQDVCEATLFYTELLRKKVDTQPGAAGEAVSEALCVVLNNVELVRKAAGQALKGLAWPEGATGPEGVLPRPLLSCTQALDDDLQREAHTVTAHLTSKMVGDIRKYVQHISLSPDSIQNDEAVAPLMKYLDEKLALLNASLVKGNLSRVLEALWELLLQAILQALGANRDVSADFYSRFHFTLEALVSFFHAEGQGLPLESLRDGSYKRLKEELRLHKCSTRECIEQFYLDKLKQRTLEQNRFGRLSVRCHYEAAEQRLAVEVLHAADLLPLDANGLSDPFVIVELGPPHLFPLVRSQRTQVKTRTLHPVYDELFYFSVPAEACRRRAACVLFTVMDHDWLSTNDFAGEAALGLGGVTGVARPQVGGGARAGQPVTLHLCRPRAQVRSALRRLEGRTSKEAQEFVKKLKELEKCMEADP

SEQ ID NO: 8234 - protein, 1169 aa, Homo sapiens; identical to SEQ ID NO: 8227
  Payload ID: 1704;
  Gene Symbol: BAIAP3;
  Gene Name: BAI1-associated prt 3;
  Uniprot ID:  O94812;
  ENSP ID: ENSP00000487275

SEQ ID NO: 8235 - protein, 593 aa, Homo sapiens
  Payload ID: 1705;
  Gene Symbol: BBS1;
  Gene Name: Bardet-Biedl syndrome 1;
  Uniprot ID:  Q8NFJ9;
  ENSP ID: ENSP00000317469
MAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 8236 - protein, 446 aa, Homo sapiens
  Payload ID: 1705;
  Gene Symbol: BBS1;
  Gene Name: Bardet-Biedl syndrome 1;
  Uniprot ID:  Q8NFJ9;
  ENSP ID: ENSP00000377563
MAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVGPALVPRGR

SEQ ID NO: 8237 - protein, 496 aa, Homo sapiens
  Payload ID: 1705;
  Gene Symbol: BBS1;
  Gene Name: Bardet-Biedl syndrome 1;
  ENSP ID: ENSP00000405764
MAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 8238 - protein, 192 aa, Homo sapiens
  Payload ID: 1705;
  Gene Symbol: BBS1;
  Gene Name: Bardet-Biedl syndrome 1;
  ENSP ID: ENSP00000431187
MAAASSSDSDACGAESNEANSKWLDAHYDPMANIHTFSACLALADLHGDGEYKDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPK

SEQ ID NO: 8239 - protein, 85 aa, Homo sapiens
  Payload ID: 1705;
  Gene Symbol: BBS1;
  Gene Name: Bardet-Biedl syndrome 1;
  ENSP ID: ENSP00000431866
MAAASSSDSDACGAESNEANSKWLDAHYDPMANIHTFSACLAGGRGPWPWWAAAPPEGAQRTTGDDRKPATCSASCCCHLPHGAT

SEQ ID NO: 8240 - protein, 85 aa, Homo sapiens; identical to SEQ ID NO: 8239
  Payload ID: 1705;
  Gene Symbol: BBS1;
  Gene Name: Bardet-Biedl syndrome 1;
  ENSP ID: ENSP00000432140

SEQ ID NO: 8241 - protein, 85 aa, Homo sapiens; identical to SEQ ID NO: 8239
  Payload ID: 1705;
  Gene Symbol: BBS1;
  Gene Name: Bardet-Biedl syndrome 1;
  ENSP ID: ENSP00000434197

SEQ ID NO: 8242 - protein, 55 aa, Homo sapiens
  Payload ID: 1705;
  Gene Symbol: BBS1;
  Gene Name: Bardet-Biedl syndrome 1;
  ENSP ID: ENSP00000434360
MANIHTFSACLAGGRGPWPWWAAAPPEGAQRTTGDDRKPATCSASCCCHLPHGAT

SEQ ID NO: 8243 - protein, 85 aa, Homo sapiens; identical to SEQ ID NO: 8239
  Payload ID: 1705;
  Gene Symbol: BBS1;
  Gene Name: Bardet-Biedl syndrome 1;
  ENSP ID: ENSP00000434619

SEQ ID NO: 8244 - protein, 164 aa, Homo sapiens
  Payload ID: 1705;
  Gene Symbol: BBS1;
  Gene Name: Bardet-Biedl syndrome 1;
  ENSP ID: ENSP00000436073
MAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEGDGRGAFVHPVTQVSAAGAK

SEQ ID NO: 8245 - protein, 55 aa, Homo sapiens; identical to SEQ ID NO: 8242
  Payload ID: 1705;
  Gene Symbol: BBS1;
  Gene Name: Bardet-Biedl syndrome 1;
  ENSP ID: ENSP00000436195

SEQ ID NO: 8246 - protein, 54 aa, Homo sapiens
  Payload ID: 1705;
  Gene Symbol: BBS1;
  Gene Name: Bardet-Biedl syndrome 1;
  ENSP ID: ENSP00000436860
MANIHTFSACLALADLHGDGEYKLVVGDLGPGGQQPRLKVLKGPLVMTESPLPA

SEQ ID NO: 8247 - protein, 66 aa, Homo sapiens
  Payload ID: 1705;
  Gene Symbol: BBS1;
  Gene Name: Bardet-Biedl syndrome 1;
  ENSP ID: ENSP00000436927
MEQHEPRTPALALASGPCVYVYKNLRPYFKFSLPQLPPNPLEQDLWNQAKEDRIDPLTLKEMLESI

SEQ ID NO: 8248 - protein, 85 aa, Homo sapiens; identical to SEQ ID NO: 8239
  Payload ID: 1705;
  Gene Symbol: BBS1;
  Gene Name: Bardet-Biedl syndrome 1;
  ENSP ID: ENSP00000486455

SEQ ID NO: 8249 - protein, 723 aa, Homo sapiens
  Payload ID: 1706;
  Gene Symbol: BBS10;
  Gene Name: Bardet-Biedl syndrome 10;
  Uniprot ID:  Q8TAM1;
  ENSP ID: ENSP00000376946
MLSSMAAAGSVKAALQVAEVLEAIVSCCVGPEGRQVLCTKPTGEVLLSRNGGRLLEALHLEHPIARMIVDCVSSHLKKTGDGAKTFIIFLCHLLRGLHAITDREKDPLMCENIQTHGRHWKNCSRWKFISQALLTFQTQILDGIMDQYLSRHFLSIFSSAKERTLCRSSLELLLEAYFCGRVGRNNHKFISQLMCDYFFKCMTCKSGIGVFELVDDHFVELNVGVTGLPVSDSRIIAGLVLQKDFSVYRPADGDMRMVIVTETIQPLFSTSGSEFILNSEAQFQTSQFWIMEKTKAIMKHLHSQNVKLLISSVKQPDLVSYYAGVNGISVVECLSSEEVSLIRRIIGLSPFVPPQAFSQCEIPNTALVKFCKPLILRSKRYVHLGLISTCAFIPHSIVLCGPVHGLIEQHEDALHGALKMLRQLFKDLDLNYMTQTNDQNGTSSLFIYKNSGESYQAPDPGNGSIQRPYQDTVAENKDALEKTQTYLKVHSNLVIPDVELETYIPYSTPTLTPTDTFQTVETLTCLSLERNRLTDYYEPLLKNNSTAYSTRGNRIEISYENLQVTNITRKGSMLPVSCKLPNMGTSQSYLSSSMPAGCVLPVGGNFEILLHYYLLNYAKKCHQSEETMVSMIIANALLGIPKVLYKSKTGKYSFPHTYIRAVHALQTNQPLVSSQTGLESVMGKYQLLTSVLQCLTKILTIDMVITVKRHPQKVHNQDSEDEL

SEQ ID NO: 8250 - protein, 710 aa, Homo sapiens
  Payload ID: 1707;
  Gene Symbol: BBS12;
  Gene Name: Bardet-Biedl syndrome 12;
  Uniprot ID:  Q6ZW61;
  ENSP ID: ENSP00000319062
MVMACRVVNKRRHMGLQQLSSFAETGRTFLGPLKSSKFIIDEECHESVLISSTVRLLESLDLTSAVGQLLNEAVQAQNNTYRTGISTLLFLVGAWSSAVEECLHLGVPISIIVSVMSEGLNFCSEEVVSLHVPVHNIFDCMDSTKTFSQLETFSVSLCPFLQVPSDTDLIEELHGLKDVASQTLTISNLSGRPLKSYELFKPQTKVEADNNTSRTLKNSLLADTCCRQSILIHSRHFNRTDNTEGVSKPDGFQEHVTATHKTYRCNDLVELAVGLSHGDHSSMKLVEEAVQLQYQNACVQQGNCTKPFMFDISRIFTCCLPGLPETSSCVCPGYITVVSVSNNPVIKELQNQPVRIVLIEGDLTENYRHLGFNKSANIKTVLDSMRLQEDSSEELWANHVLQVLIQFKVNLVLVQGNVSERLIEKCINSKRLVIGSVNGSVMQAFAEAAGAVQVAYITQVNEDCVGDGVCVTFWRSSPLDVVDRNNRIAILLKTEGINLVTAVLTNPVTAQMQIKEDRFWTCAYRLYYALKEEKVFLGGGAVEFLCLSCLHILAEQSLKKENHACSGWLHNTSSWLASSLAIYRPTVLKFLANGWQKYLSTLLYNTANYSSEFEASTYIQHHLQNATDSGSPSSYILNEYSKLNSRIFNSDISNKLEQIPRVYDVVTPKIEAWRRALDLVLLVLQTDSEIITGHGHTQINSQELTGFLFL

SEQ ID NO: 8251 - protein, 191 aa, Homo sapiens
  Payload ID: 1707;
  Gene Symbol: BBS12;
  Gene Name: Bardet-Biedl syndrome 12;
  ENSP ID: ENSP00000398912
MVMACRVVNKRRHMGLQQLSSFAETGRTFLGPLKSSKFIIDEECHESVLISSTVRLLESLDLTSAVGQLLNEAVQAQNNTYRTGISTLLFLVGAWSSAVEECLHLGVPISIIVSVMSEGLNFCSEEVVSLHVPVHNIFDCMDSTKTFSQLETFSVSLCPFLQVPSDTDLIEELHGLKDVASQTLTISNLSG

SEQ ID NO: 8252 - protein, 710 aa, Homo sapiens; identical to SEQ ID NO: 8250
  Payload ID: 1707;
  Gene Symbol: BBS12;
  Gene Name: Bardet-Biedl syndrome 12;
  Uniprot ID:  Q6ZW61;
  ENSP ID: ENSP00000438273

SEQ ID NO: 8253 - protein, 721 aa, Homo sapiens
  Payload ID: 1708;
  Gene Symbol: BBS2;
  Gene Name: Bardet-Biedl syndrome 2;
  Uniprot ID:  Q9BXC9;
  ENSP ID: ENSP00000245157
MLLPVFTLKLRHKISPRMVAIGRYDGTHPCLAAATQTGKVFIHNPHTRNQHVSASRVFQSPLESDVSLLSINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVVVWLGQNFLLPEDTHIQNAPFQVCFTSLRNGGHLHIKIKLSGEITINTDDIDLAGDIIQSMASFFAIEDLQVEADFPVYFEELRKVLVKVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 8254 - protein, 76 aa, Homo sapiens
  Payload ID: 1708;
  Gene Symbol: BBS2;
  Gene Name: Bardet-Biedl syndrome 2;
  ENSP ID: ENSP00000454986
  MOD_RES (1)..(1): Any amino acid
XNLSSSICIPIVPPKDVPVDLHLKAFVGYRSSTQFHVFESTRQLPRFSMYALTSLDPASEPISYVNFTIAERAQRQ

SEQ ID NO: 8255 - protein, 119 aa, Homo sapiens
  Payload ID: 1708;
  Gene Symbol: BBS2;
  Gene Name: Bardet-Biedl syndrome 2;
  ENSP ID: ENSP00000455651
DEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIHPGLPAWHG

SEQ ID NO: 8256 - protein, 675 aa, Homo sapiens
  Payload ID: 1708;
  Gene Symbol: BBS2;
  Gene Name: Bardet-Biedl syndrome 2;
  ENSP ID: ENSP00000456289
MLLPVFTLKLRHKISPRMVAIGRYDGTHPCLAAATQTGKVFIHNPHTRNQHVSASRVFQSPLESDVSLLSINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVVVWLGQNFLLPEDTHIQNAPFQVCFTSLRNGGHLHIKIKLSGEVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 8257 - protein, 5 aa, Homo sapiens
  Payload ID: 1708;
  Gene Symbol: BBS2;
  Gene Name: Bardet-Biedl syndrome 2;
  ENSP ID: ENSP00000456741
MTETE

SEQ ID NO: 8258 - protein, 85 aa, Homo sapiens
  Payload ID: 1708;
  Gene Symbol: BBS2;
  Gene Name: Bardet-Biedl syndrome 2;
  ENSP ID: ENSP00000463176
  MOD_RES (1)..(1): Any amino acid
XKTMKSRYMELYDLNRDLLNGYKIRCNNHTELLGNLKAVNQAIQRAGRLRVGKPKNQVITACRDAIRSNNINTLFKIMRVGTASS

SEQ ID NO: 8259 - protein, 142 aa, Homo sapiens
  Payload ID: 1708;
  Gene Symbol: BBS2;
  Gene Name: Bardet-Biedl syndrome 2;
  ENSP ID: ENSP00000463731
LQVEADFPVYFEELRKVLVKVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 8260 - protein, 519 aa, Homo sapiens
  Payload ID: 1709;
  Gene Symbol: BBS4;
  Gene Name: Bardet-Biedl syndrome 4;
  Uniprot ID:  Q96RK4;
  ENSP ID: ENSP00000268057
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKAQDQLHNALNLNRHDLTYIMLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDIENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 8261 - protein, 347 aa, Homo sapiens
  Payload ID: 1709;
  Gene Symbol: BBS4;
  Gene Name: Bardet-Biedl syndrome 4;
  Uniprot ID:  Q96RK4;
  ENSP ID: ENSP00000378631
MLGKIHLLEGDLDKAIEVYKKAVEFSPENTELLTTLGLLYLQLGIYQKAFEHLGNALTYDPTNYKAILAAGSMMQTHGDFDVALTKYRVVACAVPESPPLWNNIGMCFFGKKKYVAAISCLKRANYLAPFDWKILYNLGLVHLTMQQYASAFHFLSAAINFQPKMGELYMLLAVALTNLEDIENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLPLEPEPAVESSPTETSEQIREK

SEQ ID NO: 8262 - protein, 77 aa, Homo sapiens
  Payload ID: 1709;
  Gene Symbol: BBS4;
  Gene Name: Bardet-Biedl syndrome 4;
  ENSP ID: ENSP00000454718
MAEERVATVSAEILFSCPAAGQGKLAGGFCPMQRFLERGGAGCRASQGGRGDTVPFLLSRELVAWGKSGYLAAQVLF

SEQ ID NO: 8263 - protein, 142 aa, Homo sapiens
  Payload ID: 1709;
  Gene Symbol: BBS4;
  Gene Name: Bardet-Biedl syndrome 4;
  ENSP ID: ENSP00000455412
MAEERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWPRRSAIT

SEQ ID NO: 8264 - protein, 141 aa, Homo sapiens
  Payload ID: 1709;
  Gene Symbol: BBS4;
  Gene Name: Bardet-Biedl syndrome 4;
  ENSP ID: ENSP00000455958
MALTVVPSFSVSGVWKRTQFPVSTESQKPRQKKEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDW

SEQ ID NO: 8265 - protein, 20 aa, Homo sapiens
  Payload ID: 1709;
  Gene Symbol: BBS4;
  Gene Name: Bardet-Biedl syndrome 4;
  ENSP ID: ENSP00000456463
MAEERVATLQSFLFWRSRTG

SEQ ID NO: 8266 - protein, 67 aa, Homo sapiens
  Payload ID: 1709;
  Gene Symbol: BBS4;
  Gene Name: Bardet-Biedl syndrome 4;
  ENSP ID: ENSP00000456664
MAEERVATRTQFPVSTESQKPRQKKGGVGVSNDLEYQKFNLYIYSSRVSYFGEAELVDSSSLYPERL

SEQ ID NO: 8267 - protein, 281 aa, Homo sapiens
  Payload ID: 1709;
  Gene Symbol: BBS4;
  Gene Name: Bardet-Biedl syndrome 4;
  ENSP ID: ENSP00000456758
ERVATRTQFPVSTESQKPRQKKAPEFPILEKQNWLIHLHYIRKDYEACKAVIKEQLQETQGLCEYAIYVQALIFRLEGNIQESLELFQTCAVLSPQSADNLKQVARSLFLLGKHKAAIEVYNEAAKLNQKDWEISHNLGVCYIYLKQFNKAQDQLHNALNLNRHDLTYIMLGKIHLLEGDLDKAIEVYKKAVEFSPENTELLTTLGLLYLQAILAAGSMMQTHGDFDVALTKYRVVACAVPESPPLWNNIGMCFFGKKKYVAAISCLKRANYLAPFDWKIL

SEQ ID NO: 8268 - protein, 20 aa, Homo sapiens
  Payload ID: 1709;
  Gene Symbol: BBS4;
  Gene Name: Bardet-Biedl syndrome 4;
  ENSP ID: ENSP00000456759
MAEERVATLQSFLFWRSRTG

SEQ ID NO: 8269 - protein, 180 aa, Homo sapiens
  Payload ID: 1709;
  Gene Symbol: BBS4;
  Gene Name: Bardet-Biedl syndrome 4;
  ENSP ID: ENSP00000457479
  MOD_RES (1)..(1): Any amino acid
XNFQPKMGELYMLLAAELSSCSAFFVAVALTNLEDIENAKRAYAEAVHLDKCNPLVNLNYAVLLYNQGEKKNALAQYQEMEKKVSLLKDNSSLEFDSEMVEMAQKLGAALQVGEALVWTKPVKDPKSKHQTTSTSKPASFQQPLGSNQALGQAMSSAAAYRTLPSGAGGTSQFTKPPSLP

SEQ ID NO: 8270 - protein, 50 aa, Homo sapiens
  Payload ID: 1709;
  Gene Symbol: BBS4;
  Gene Name: Bardet-Biedl syndrome 4;
  ENSP ID: ENSP00000457753
MAEERVATDCSPSWGALDGEGRLFTSNGSYRSAIFFCLGGLEENSISCIY

SEQ ID NO: 8271 - protein, 103 aa, Homo sapiens
  Payload ID: 1709;
  Gene Symbol: BBS4;
  Gene Name: Bardet-Biedl syndrome 4;
  ENSP ID: ENSP00000457795
MAEERVATRTQFPVSTESQKPRQKKAPEFPILEKQNWLIHLHYIRKDYEACKAVIKEQLQETQGLCEYAIYVQDFFWENIKLPLKYIMKQLNSTRKIGRSAIT

SEQ ID NO: 8272 - protein, 33 aa, Homo sapiens
  Payload ID: 1709;
  Gene Symbol: BBS4;
  Gene Name: Bardet-Biedl syndrome 4;
  ENSP ID: ENSP00000457958
MAEERVATRTQFPVSTESQKPRQKKGDFLLAFS

SEQ ID NO: 8273 - protein, 341 aa, Homo sapiens
  Payload ID: 1710;
  Gene Symbol: BBS5;
  Gene Name: Bardet-Biedl syndrome 5;
  Uniprot ID:  Q8N3I7;
  ENSP ID: ENSP00000295240
MSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQIRSIKIRDSKFGLALVIESSQQSGGYVLGFKIDPVEKLQESVKEINSLHKVYSASPIFGVDYEMEEKPQPLEALTVEQIQDDVEIDSDGHTDAFVAYFADGNKQQDREPVFSEELGLAIEKLKDGFTLQGLWEVMS

SEQ ID NO: 8274 - protein, 320 aa, Homo sapiens
  Payload ID: 1710;
  Gene Symbol: BBS5;
  Gene Name: Bardet-Biedl syndrome 5;
  Uniprot ID:  Q8N3I7;
  ENSP ID: ENSP00000376431
MSVLDALWEDRDVRFDLSAQQMKTRPGEVLIDCLDSIEDTKGNNGDRGRLLVTNLRILWHSLALSRVNVSVGYNCILNITTRTANSKLRGQTEALYILTKCNSTRFEFIFTNLVPGSPRLFTSVMAVHRAYETSKMYRDFKLRSALIQNKQLRLLPQEHVYDKINGVWNLSSDQGNLGTFFITNVRIVWHANMNDSFNVSIPYLQISGGYVLGFKIDPVEKLQESVKEINSLHKVYSASPIFGVDYEMEEKPQPLEALTVEQIQDDVEIDSDGHTDAFVAYFADGNKQQDREPVFSEELGLAIEKLKDGFTLQGLWEVMS

SEQ ID NO: 8275 - protein, 53 aa, Homo sapiens
  Payload ID: 1710;
  Gene Symbol: BBS5;
  Gene Name: Bardet-Biedl syndrome 5;
  ENSP ID: ENSP00000406182
MSVLDALWEDRDVRFDLSAQQMKTRPGEVLIDCLDSIEDTKGNNGDREITRPN

SEQ ID NO: 8276 - protein, 715 aa, Homo sapiens
  Payload ID: 1711;
  Gene Symbol: BBS7;
  Gene Name: Bardet-Biedl syndrome 7;
  Uniprot ID:  Q8IWZ6;
  ENSP ID: ENSP00000264499
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 8277 - protein, 138 aa, Homo sapiens
  Payload ID: 1711;
  Gene Symbol: BBS7;
  Gene Name: Bardet-Biedl syndrome 7;
  ENSP ID: ENSP00000423250
DVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 8278 - protein, 672 aa, Homo sapiens
  Payload ID: 1711;
  Gene Symbol: BBS7;
  Gene Name: Bardet-Biedl syndrome 7;
  Uniprot ID:  Q8IWZ6;
  ENSP ID: ENSP00000423626
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYG

SEQ ID NO: 8279 - protein, 887 aa, Homo sapiens
  Payload ID: 1712;
  Gene Symbol: BBS9;
  Gene Name: Bardet-Biedl syndrome 9;
  Uniprot ID:  Q3SYG4;
  ENSP ID: ENSP00000242067
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 8280 - protein, 847 aa, Homo sapiens
  Payload ID: 1712;
  Gene Symbol: BBS9;
  Gene Name: Bardet-Biedl syndrome 9;
  Uniprot ID:  Q3SYG4;
  ENSP ID: ENSP00000313122
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMSIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 8281 - protein, 882 aa, Homo sapiens
  Payload ID: 1712;
  Gene Symbol: BBS9;
  Gene Name: Bardet-Biedl syndrome 9;
  Uniprot ID:  Q3SYG4;
  ENSP ID: ENSP00000347182
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMTPDLTRTVSFSVYLKRSYTPSELEGNAVVSYSRPTGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 8282 - protein, 852 aa, Homo sapiens
  Payload ID: 1712;
  Gene Symbol: BBS9;
  Gene Name: Bardet-Biedl syndrome 9;
  Uniprot ID:  Q3SYG4;
  ENSP ID: ENSP00000379433
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMNRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 8283 - protein, 454 aa, Homo sapiens
  Payload ID: 1712;
  Gene Symbol: BBS9;
  Gene Name: Bardet-Biedl syndrome 9;
  ENSP ID: ENSP00000388114
  MOD_RES (1)..(1): Any amino acid
XDLVPSVTVKVTLQNRVILQKAKLSVYVQPPLELTCDQFTFEFMTPDLTRTVSFSVYLKRSYTPSELEGNAVVSYSRPTDRNPDGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPGKRLDGLHKR

SEQ ID NO: 8284 - protein, 146 aa, Homo sapiens
  Payload ID: 1712;
  Gene Symbol: BBS9;
  Gene Name: Bardet-Biedl syndrome 9;
  ENSP ID: ENSP00000388646
MKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNF

SEQ ID NO: 8285 - protein, 310 aa, Homo sapiens
  Payload ID: 1712;
  Gene Symbol: BBS9;
  Gene Name: Bardet-Biedl syndrome 9;
  Uniprot ID:  Q3SYG4;
  ENSP ID: ENSP00000405151
MGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLQFSLWKHLLPRSSTLEK

SEQ ID NO: 8286 - protein, 460 aa, Homo sapiens
  Payload ID: 1712;
  Gene Symbol: BBS9;
  Gene Name: Bardet-Biedl syndrome 9;
  ENSP ID: ENSP00000412159
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKQPRYTTMQVSIIINPVN

SEQ ID NO: 8287 - protein, 97 aa, Homo sapiens
  Payload ID: 1712;
  Gene Symbol: BBS9;
  Gene Name: Bardet-Biedl syndrome 9;
  ENSP ID: ENSP00000415794
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAV

SEQ ID NO: 8288 - protein, 183 aa, Homo sapiens
  Payload ID: 1712;
  Gene Symbol: BBS9;
  Gene Name: Bardet-Biedl syndrome 9;
  ENSP ID: ENSP00000485871
  MOD_RES (1)..(1): Any amino acid
XIQKESIGKGQAHRDRSSSGFWVSSRTSSTVFQPSGCFKPEGIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRING

SEQ ID NO: 8289 - protein, 327 aa, Homo sapiens
  Payload ID: 1713;
  Gene Symbol: BARHL1;
  Gene Name: BarH-like homeobox 1;
  Uniprot ID:  Q9BZE3;
  ENSP ID: ENSP00000263610
MEGSNGFGIDSILSHRAGSPALPKGDPLLGDCRSPLELSPRSESSSDCSSPASPGRDCLETGTPRPGGASGPGLDSHLQPGQLSAPAQSRTVTSSFLIRDILADCKPLAACAPYSSSGQPAAPEPGGRLAAKAAEDFRDKLDKSGSNASSDSEYKVKEEGDREISSSRDSPPVRLKKPRKARTAFTDHQLAQLERSFERQKYLSVQDRMELAASLNLTDTQVKTWYQNRRTKWKRQTAVGLELLAEAGNYSALQRMFPSPYFYPQSLVSNLDPGAALYLYRGPSAPPPALQRPLVPRILIHGLQGASEPPPPLPPLAGVLPRAAQPR

SEQ ID NO: 8290 - protein, 327 aa, Homo sapiens; identical to SEQ ID NO: 8289
  Payload ID: 1713;
  Gene Symbol: BARHL1;
  Gene Name: BarH-like homeobox 1;
  Uniprot ID:  Q9BZE3;
  ENSP ID: ENSP00000444704

SEQ ID NO: 8291 - protein, 387 aa, Homo sapiens
  Payload ID: 1714;
  Gene Symbol: BARHL2;
  Gene Name: BarH-like homeobox 2;
  Uniprot ID:  Q9NY43;
  ENSP ID: ENSP00000359474
MTMEGASGSSFGIDTILSSASSGSPGMMNGDFRPLGEARTADFRSQATPSPCSEIDTVGTAPSSPISVTMEPPEPHLVADATQHHHHLHHSQQPPPPAAAPTQSLQPLPQQQQPLPPQQPPPPPPQQLGSAASAPRTSTSSFLIKDILGDSKPLAACAPYSTSVSSPHHTPKQESNAVHESFRPKLEQEDSKTKLDKREDSQSDIKCHGTKEEGDREITSSRESPPVRAKKPRKARTAFSDHQLNQLERSFERQKYLSVQDRMDLAAALNLTDTQVKTWYQNRRTKWKRQTAVGLELLAEAGNYSALQRMFPSPYFYHPSLLGSMDSTTAAAAAAAMYSSMYRTPPAPHPQLQRPLVPRVLIHGLGPGGQPALNPLSSPIPGTPHPR

SEQ ID NO: 8292 - protein, 89 aa, Homo sapiens
  Payload ID: 1715;
  Gene Symbol: BANF1;
  Gene Name: barrier to autointegration  factor 1;
  Uniprot ID:  O75531;
  ENSP ID: ENSP00000310275
MTTSQKHRDFVAEPMGEKPVGSLAGIGEVLGKKLEERGFDKAYVVLGQFLVLKKDEDLFREWLKDTCGANAKQSRDCFGCLREWCDAFL

SEQ ID NO: 8293 - protein, 89 aa, Homo sapiens; identical to SEQ ID NO: 8292
  Payload ID: 1715;
  Gene Symbol: BANF1;
  Gene Name: barrier to autointegration  factor 1;
  Uniprot ID:  O75531;
  ENSP ID: ENSP00000416128

SEQ ID NO: 8294 - protein, 28 aa, Homo sapiens
  Payload ID: 1715;
  Gene Symbol: BANF1;
  Gene Name: barrier to autointegration  factor 1;
  ENSP ID: ENSP00000431785
MTTSQKHRDFVAEPMGEKPVGSLAGIGE

SEQ ID NO: 8295 - protein, 89 aa, Homo sapiens; identical to SEQ ID NO: 8292
  Payload ID: 1715;
  Gene Symbol: BANF1;
  Gene Name: barrier to autointegration  factor 1;
  Uniprot ID:  O75531;
  ENSP ID: ENSP00000432867

SEQ ID NO: 8296 - protein, 89 aa, Homo sapiens; identical to SEQ ID NO: 8292
  Payload ID: 1715;
  Gene Symbol: BANF1;
  Gene Name: barrier to autointegration  factor 1;
  Uniprot ID:  O75531;
  ENSP ID: ENSP00000433760

SEQ ID NO: 8297 - protein, 90 aa, Homo sapiens
  Payload ID: 1716;
  Gene Symbol: BANF2;
  Gene Name: barrier to autointegration  factor 2;
  Uniprot ID:  Q9H503;
  ENSP ID: ENSP00000246090
MDNMSPRLRAFLSEPIGEKDVCWVDGISHELAINLVTKGINKAYILLGQFLLMHKNEAEFQRWLICCFGATECEAQQTSHCLKEWCACFL

SEQ ID NO: 8298 - protein, 90 aa, Homo sapiens; identical to SEQ ID NO: 8297
  Payload ID: 1716;
  Gene Symbol: BANF2;
  Gene Name: barrier to autointegration  factor 2;
  Uniprot ID:  Q9H503;
  ENSP ID: ENSP00000367036

SEQ ID NO: 8299 - protein, 42 aa, Homo sapiens
  Payload ID: 1716;
  Gene Symbol: BANF2;
  Gene Name: barrier to autointegration  factor 2;
  ENSP ID: ENSP00000398738
MDNMSPRLRAFLSEPIGEKDVCWVDGISHELAINLVTKGINK

SEQ ID NO: 8300 - protein, 97 aa, Homo sapiens
  Payload ID: 1716;
  Gene Symbol: BANF2;
  Gene Name: barrier to autointegration  factor 2;
  Uniprot ID:  Q9H503;
  ENSP ID: ENSP00000439128
MLRGTKEMDNMSPRLRAFLSEPIGEKDVCWVDGISHELAINLVTKGINKAYILLGQFLLMHKNEAEFQRWLICCFGATECEAQQTSHCLKEWCACFL

SEQ ID NO: 8301 - protein, 320 aa, Homo sapiens
  Payload ID: 1717;
  Gene Symbol: BSND;
  Gene Name: barttin CLCNK-type chloride channel accessory beta subunit;
  Uniprot ID:  Q8WZ55;
  ENSP ID: ENSP00000360312
MADEKTFRIGFIVLGLFLLALGTFLMSHDRPQVYGTFYAMGSVMVIGGIIWSMCQCYPKITFVPADSDFQGILSPKAMGLLENGLAAEMKSPSPQPPYVRLWEEAAYDQSLPDFSHIQMKVMSYSEDHRSLLAPEMGQPKLGTSDGGEGGPGDVQAWMEAAVVIHKGSDESEGERRLTQSWPGPLACPQGPAPLASFQDDLDMDSSEGSSPNASPHDREEACSPQQEPQGCRCPLDRFQDFALIDAPTLEDEPQEGQQWEIALPNNWQRYPRTKVEEKEASDTGGEEPEKEEEDLYYGLPDGAGDLLPDKELGFEPDTQG

SEQ ID NO: 8302 - protein, 254 aa, Homo sapiens
  Payload ID: 1718;
  Gene Symbol: BARX1;
  Gene Name: BARX homeobox 1;
  Uniprot ID:  Q9HBU1;
  ENSP ID: ENSP00000253968
MQRPGEPGAARFGPPEGCADHRPHRYRSFMIEEILTEPPGPKGAAPAAAAAAAGELLKFGVQALLAARPFHSHLAVLKAEQAAVFKFPLAPLGCSGLSSALLAAGPGLPGAAGAPHLPLELQLRGKLEAAGPGEPGTKAKKGRRSRTVFTELQLMGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 8303 - protein, 100 aa, Homo sapiens
  Payload ID: 1718;
  Gene Symbol: BARX1;
  Gene Name: BARX homeobox 1;
  Uniprot ID:  Q9HBU1;
  ENSP ID: ENSP00000385613
MGLEKRFEKQKYLSTPDRIDLAESLGLSQLQVKTWYQNRRMKWKKIVLQGGGLESPTKPKGRPKKNSIPTSEQLTEQERAKDAEKPAEVPGEPSDRSRED

SEQ ID NO: 8304 - protein, 279 aa, Homo sapiens
  Payload ID: 1719;
  Gene Symbol: BARX2;
  Gene Name: BARX homeobox 2;
  Uniprot ID:  Q9UMQ3;
  ENSP ID: ENSP00000281437
MHCHAELRLSSPGQLKAARRRYKTFMIDEILSKETCDYFEKLSLYSVCPSLVVRPKPLHSCTGSPSLRAYPLLSVITRQPTVISHLVPATPGIAQALSCHQVTEAVSAEAPGGEALASSESETEQPTPRQKKPRRSRTIFTELQLMGLEKKFQKQKYLSTPDRLDLAQSLGLTQLQVKTWYQNRRMKWKKMVLKGGQEAPTKPKGRPKKNSIPTSEEIEAEEKMNSQAQGQEQLEPSQGQEELCEAQEPKARDVPLEMAEPPDPPQELPIPSSEPPPLS

SEQ ID NO: 8305 - protein, 529 aa, Homo sapiens
  Payload ID: 1720;
  Gene Symbol: BBOF1;
  Gene Name: basal body orientation  factor 1;
  Uniprot ID:  Q8ND07;
  ENSP ID: ENSP00000377577
MPSKGKDKKKGKSKGKDTKKLIKTDESVVDRAKANASLWEARLEVTELSRIKYRDTSRILAKSNEDLKKKQCKMEKDIMSVLSYLKKQDQEKDNMIEKLKQQLNETKEKAQEEKDKLEQKYTRQINELEGQFHQKAKEIGMIHTELKAVRQFQKRKIQVERELDDLKENLRNTERIHQETLRRLESRFFEEKHRLEQEAEKKIIMLAERAHHEAIVQLNDAGRNVFKENDYLQKALAYHLKETDALQKNSQKLQESHTLLLHQKEINDLLVKEKIMQLVQQRSQIQTLQKKVVNLETALSYMTKEFESEVLKLQQHAMIENQAGQVEIDKLQHLLQMKDREMNRVKKLAKNILDERTEVERFFLDALHQVKQQILISRKHYKQIAQAAFNLKMRAACTGRTEYPKIRTFDGREHSTNSVNQDLLEAEKWTHIEGNVDIGDLTWEQKEKVLRLLFAKMNGCPSRKYNQSSRPPVPDYVVSDSGETKEFGDESKLQDKIFITQQIAISDSSGEVVLPTIPKEPQESDTGTF

SEQ ID NO: 8306 - protein, 124 aa, Homo sapiens
  Payload ID: 1720;
  Gene Symbol: BBOF1;
  Gene Name: basal body orientation  factor 1;
  ENSP ID: ENSP00000451659
MIHTELKAVRQFQKRKIQVERELDDLKENLRNTERIHQETLRRLESRFFEEKHRLEQEAEKKIIMLAERAHHEAIVQLNDAGRNVFKENDYLQKALAYHLKETDALQKNSQKLQESHTLLLHQK

SEQ ID NO: 8307 - protein, 65 aa, Homo sapiens
  Payload ID: 1720;
  Gene Symbol: BBOF1;
  Gene Name: basal body orientation  factor 1;
  ENSP ID: ENSP00000480689
MIHTELKAVRQFQKRKIQVERELDDLKENLRNTERIHQETLRRLESRFFEEKVQIIRVNLKCFVY

SEQ ID NO: 8308 - protein, 628 aa, Homo sapiens
  Payload ID: 1721;
  Gene Symbol: BCAM;
  Gene Name: basal cell adhesion molecule (Lutheran blood group);
  Uniprot ID:  P50895;
  ENSP ID: ENSP00000270233
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 8309 - protein, 291 aa, Homo sapiens
  Payload ID: 1721;
  Gene Symbol: BCAM;
  Gene Name: basal cell adhesion molecule (Lutheran blood group);
  ENSP ID: ENSP00000467100
MEPPDAPAQARGAPRLLLLAVLLAAHPDAQAEVRLSVPPLVEVMRGKSVILDCTPTGTHDHYMLEWFLVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQVTHPR

SEQ ID NO: 8310 - protein, 61 aa, Homo sapiens
  Payload ID: 1721;
  Gene Symbol: BCAM;
  Gene Name: basal cell adhesion molecule (Lutheran blood group);
  ENSP ID: ENSP00000468189
  MOD_RES (1)..(1): Any amino acid
XGYMTSRTVREASGLLSLTSTLYLRLRKDDRDASFHCAAHYSLPEGRHGRLDSPTFHLTLH

SEQ ID NO: 8311 - protein, 588 aa, Homo sapiens
  Payload ID: 1721;
  Gene Symbol: BCAM;
  Gene Name: basal cell adhesion molecule (Lutheran blood group);
  ENSP ID: ENSP00000476710
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAP

SEQ ID NO: 8312 - protein, 588 aa, Homo sapiens; identical to SEQ ID NO: 8311
  Payload ID: 1721;
  Gene Symbol: BCAM;
  Gene Name: basal cell adhesion molecule (Lutheran blood group);
  ENSP ID: ENSP00000481153

SEQ ID NO: 8313 - protein, 106 aa, Homo sapiens
  Payload ID: 1722;
  Gene Symbol: BPY2;
  Gene Name: basic charge, Y-linked, 2;
  Uniprot ID:  O14599;
  ENSP ID: ENSP00000329106
MMTLVPRARTRAGQDHYSHPCPRFSQVLLTEGIMTYCLTKNLSDVNILHRLLKNGNVRNTLLQSKVGLLTYYVKLYPGEVTLLTRPSIQMRLCCITGSVSRPRSQK

SEQ ID NO: 8314 - protein, 106 aa, Homo sapiens; identical to SEQ ID NO: 8313
  Payload ID: 1722;
  Gene Symbol: BPY2;
  Gene Name: basic charge, Y-linked, 2;
  Uniprot ID:  O14599;
  ENSP ID: ENSP00000372028

SEQ ID NO: 8315 - protein, 11 aa, Homo sapiens
  Payload ID: 1722;
  Gene Symbol: BPY2;
  Gene Name: basic charge, Y-linked, 2;
  ENSP ID: ENSP00000473270
MMTLVPRARTR

SEQ ID NO: 8316 - protein, 106 aa, Homo sapiens; identical to SEQ ID NO: 8313
  Payload ID: 1723;
  Gene Symbol: BPY2B;
  Gene Name: basic charge, Y-linked, 2B;
  Uniprot ID:  O14599;
  ENSP ID: ENSP00000371829

SEQ ID NO: 8317 - protein, 11 aa, Homo sapiens
  Payload ID: 1723;
  Gene Symbol: BPY2B;
  Gene Name: basic charge, Y-linked, 2B;
  ENSP ID: ENSP00000473491
MMTLVPRARTR

SEQ ID NO: 8318 - protein, 106 aa, Homo sapiens; identical to SEQ ID NO: 8313
  Payload ID: 1723;
  Gene Symbol: BPY2B;
  Gene Name: basic charge, Y-linked, 2B;
  Uniprot ID:  O14599;
  ENSP ID: ENSP00000480184

SEQ ID NO: 8319 - protein, 106 aa, Homo sapiens; identical to SEQ ID NO: 8313
  Payload ID: 1724;
  Gene Symbol: BPY2C;
  Gene Name: basic charge, Y-linked, 2C;
  Uniprot ID:  O14599;
  ENSP ID: ENSP00000371724

SEQ ID NO: 8320 - protein, 11 aa, Homo sapiens
  Payload ID: 1724;
  Gene Symbol: BPY2C;
  Gene Name: basic charge, Y-linked, 2C;
  ENSP ID: ENSP00000473549
MMTLVPRARTR

SEQ ID NO: 8321 - protein, 106 aa, Homo sapiens; identical to SEQ ID NO: 8313
  Payload ID: 1724;
  Gene Symbol: BPY2C;
  Gene Name: basic charge, Y-linked, 2C;
  Uniprot ID:  O14599;
  ENSP ID: ENSP00000480751

SEQ ID NO: 8322 - protein, 638 aa, Homo sapiens
  Payload ID: 1725;
  Gene Symbol: BHMG1;
  Gene Name: basic helix-loop-helix and HMG box domain containing 1;
  Uniprot ID:  C9JSJ3;
  ENSP ID: ENSP00000402674
MFGSSRYLGSSEQPRANSLGPSDRTLVLCSLVEGEDKVNPSEPHGLRMEEKWLLKGKLRNQRNQNKLLSPNKKQRKNHTSKLQELALLLPIALKTGTKKLTKKEILVHVLQYIQYLQRNIDAAKALFKCHITTGEGGLAGLGQKPAWGPARRRRHSTPSSSPSSQKSCLQGACQKPRKKKLTQASESQTRTPKPRRSLALNKPEKLVAPSPDQKGSGTGGTTTPPRCPDSCGHPRPASSSPPGDRKGGQSQLTLLDLAEDTIHCDISSCWCQGSVQDDAPFPALLAQEDVARIHFLNKTQPHPRQKLVFYDSSEDVDKGSLDADPWLPAWTPENSPQGSPLFLGPPQIDVWSGTGHPSEILGLSPSLFSSPGKLLPDEILEDDMEYLTQAAFFEEVCLDLESSPSAYTQEAPQEKDTASKAPKDPPESHSLHRSSVSLDHCYLSLSGNSKAPSSSSSSSSSSSSSEDSDSEPLWKQREDMQANPVGTPGSSEEDEDTTWTPTRLASPLLAAEKKATKGQVARAPVKPKEKKKGPCPPQMKKKCVNGFIMFCRMNRKQYIRSCPGTASTAATKELAQLWRVMTQQERRPYCTKARRFSRQHNRIVKQDGSSSEAEDWETPKPFYQLLAEKALPLPPHLQ

SEQ ID NO: 8323 - protein, 547 aa, Homo sapiens
  Payload ID: 1726;
  Gene Symbol: BHLHB9;
  Gene Name: basic helix-loop-helix domain containing, class B, 9;
  Uniprot ID:  Q6PI77;
  ENSP ID: ENSP00000354675
MAGTKNKTRAQAKTEKKAAIQAKAGAEREATGVVRPVAKTRAKAKAKTGSKTDAVAEMKAVSKNKVVAETKEGALSEPKTLGKAMGDFTPKAGNESTSSTCKNEAGTDAWFWAGEEATINSWFWNGEEAGNSFSTKNDKPEIGAQVCAEELEPAAGADCKPRSGAEEEEEENVIGNWFWEGDDTSFDPNPKPVSRIVKPQPVYEINEKNRPKDWSEVTIWPNAPAVTPAVLGFRSQAPSEASPPSYIVLASAEENACSLPVATACRPSRNTRSCSQPIPECRFDSDPCIQTIDEIRRQIRIREVNGIKPFACPCKMECYMDSEEFEKLVSLLKSTTDPLIHKIARIAMGVHNVHPFAQEFINEVGVVTLIESLLSFPSPEMRKKTVITLNPPSGDERQRKIELHVKHMCKETMSFPLNSPGQQSGLKILGQLTTDFVHHYIVANYFSELFHLLSSGNCKTRNLVLKLLLNMSENPTAARDMINMKALAALKLIFNQKEAKANLVSGVAIFINIKEHIRKGSIVVVDHLSYNTLMAIFREVKEIIETM

SEQ ID NO: 8324 - protein, 547 aa, Homo sapiens; identical to SEQ ID NO: 8323
  Payload ID: 1726;
  Gene Symbol: BHLHB9;
  Gene Name: basic helix-loop-helix domain containing, class B, 9;
  Uniprot ID:  Q6PI77;
  ENSP ID: ENSP00000361820

SEQ ID NO: 8325 - protein, 547 aa, Homo sapiens; identical to SEQ ID NO: 8323
  Payload ID: 1726;
  Gene Symbol: BHLHB9;
  Gene Name: basic helix-loop-helix domain containing, class B, 9;
  Uniprot ID:  Q6PI77;
  ENSP ID: ENSP00000391722

SEQ ID NO: 8326 - protein, 547 aa, Homo sapiens; identical to SEQ ID NO: 8323
  Payload ID: 1726;
  Gene Symbol: BHLHB9;
  Gene Name: basic helix-loop-helix domain containing, class B, 9;
  Uniprot ID:  Q6PI77;
  ENSP ID: ENSP00000403226

SEQ ID NO: 8327 - protein, 547 aa, Homo sapiens; identical to SEQ ID NO: 8323
  Payload ID: 1726;
  Gene Symbol: BHLHB9;
  Gene Name: basic helix-loop-helix domain containing, class B, 9;
  Uniprot ID:  Q6PI77;
  ENSP ID: ENSP00000405893

SEQ ID NO: 8328 - protein, 189 aa, Homo sapiens
  Payload ID: 1727;
  Gene Symbol: BHLHA15;
  Gene Name: basic helix-loop-helix family, member a15;
  Uniprot ID:  Q7RTS1;
  ENSP ID: ENSP00000326391
MKTKNRPPRRRAPVQDTEATPGEGTPDGSLPNPGPEPAKGLRSRPARAAARAPGEGRRRRPGPSGPGGRRDSSIQRRLESNERERQRMHKLNNAFQALREVIPHVRADKKLSKIETLTLAKNYIKSLTATILTMSSSRLPGLEGPGPKLYQHYQQQQQVAGGALGATEAQPQGHLQRYSTQIHSFREGT

SEQ ID NO: 8329 - protein, 189 aa, Homo sapiens; identical to SEQ ID NO: 8328
  Payload ID: 1727;
  Gene Symbol: BHLHA15;
  Gene Name: basic helix-loop-helix family, member a15;
  Uniprot ID:  Q7RTS1;
  ENSP ID: ENSP00000476312

SEQ ID NO: 8330 - protein, 235 aa, Homo sapiens
  Payload ID: 1728;
  Gene Symbol: BHLHA9;
  Gene Name: basic helix-loop-helix family, member a9;
  Uniprot ID:  Q7RTU4;
  ENSP ID: ENSP00000375248
MLRGAPGLGLTARKGAEDSAEDLGGPCPEPGGDSGVLGANGASCSRGEAEEPAGRRRARPVRSKARRMAANVRERKRILDYNEAFNALRRALRHDLGGKRLSKIATLRRAIHRIAALSLVLRASPAPRGPCGHLECHGPAARGDTGDTGASPPPPAGPSLARPDAARPSVPSAPRCASCPPHAPLARPSAVAEGPGLAQASGGSWRRCPGASSAGPPPWPRGYLRSAPGMGHPRS

SEQ ID NO: 8331 - protein, 381 aa, Homo sapiens
  Payload ID: 1729;
  Gene Symbol: BHLHE22;
  Gene Name: basic helix-loop-helix family, member e22;
  Uniprot ID:  Q8NFJ8;
  ENSP ID: ENSP00000318799
MERGMHLGAAAAGEDDLFLHKSLSASTSKRLEAAFRSTPPGMDLSLAPPPRERPASSSSSPLGCFEPADPEGAGLLLPPPGGGGGGSAGSGGGGGGGVGVPGLLVGSAGVGGDPSLSSLPAGAALCLKYGESASRGSVAESSGGEQSPDDDSDGRCELVLRAGVADPRASPGAGGGGAKAAEGCSNAHLHGGASVPPGGLGGGGGGGSSSGSSGGGGGSGSGSGGSSSSSSSSSKKSKEQKALRLNINARERRRMHDLNDALDELRAVIPYAHSPSVRKLSKIATLLLAKNYILMQAQALEEMRRLVAYLNQGQAISAASLPSSAAAAAAAAALHPALGAYEQAAGYPFSAGLPPAASCPEKCALFNSVSSSLCKQCTEKP

SEQ ID NO: 8332 - protein, 225 aa, Homo sapiens
  Payload ID: 1730;
  Gene Symbol: BHLHE23;
  Gene Name: basic helix-loop-helix family, member e23;
  Uniprot ID:  Q8NDY6;
  ENSP ID: ENSP00000359371
MAELKSLSGDAYLALSHGYAAAAAGLAYGAAREPEAARGYGTPGPGGDLPAAPAPRAPAQAAESSGEQSGDEDDAFEQRRRRRGPGSAADGRRRPREQRSLRLSINARERRRMHDLNDALDGLRAVIPYAHSPSVRKLSKIATLLLAKNYILMQAQALDEMRRLVAFLNQGQGLAAPVNAAPLTPFGQATVCPFSAGAALGPCPDKCAAFSGTPSALCKHCHEKP

SEQ ID NO: 8333 - protein, 241 aa, Homo sapiens
  Payload ID: 1730;
  Gene Symbol: BHLHE23;
  Gene Name: basic helix-loop-helix family, member e23;
  ENSP ID: ENSP00000480998
MSIRPPGEPPSPGGAAMAELKSLSGDAYLALSHGYAAAAAGLAYGAAREPEAARGYGTPGPGGDLPAAPAPRAPAQAAESSGEQSGDEDDAFEQRRRRRGPGSAADGRRRPREQRSLRLSINARERRRMHDLNDALDGLRAVIPYAHSPSVRKLSKIATLLLAKNYILMQAQALDEMRRLVAFLNQGQGLAAPVNAAPLTPFGQATVCPFSAGAALGPCPDKCAAFSGTPSALCKHCHEKP

SEQ ID NO: 8334 - protein, 412 aa, Homo sapiens
  Payload ID: 1731;
  Gene Symbol: BHLHE40;
  Gene Name: basic helix-loop-helix family, member e40;
  Uniprot ID:  O14503;
  ENSP ID: ENSP00000256495
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 8335 - protein, 482 aa, Homo sapiens
  Payload ID: 1732;
  Gene Symbol: BHLHE41;
  Gene Name: basic helix-loop-helix family, member e41;
  Uniprot ID:  Q9C0J9;
  ENSP ID: ENSP00000242728
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 8336 - protein, 419 aa, Homo sapiens
  Payload ID: 1733;
  Gene Symbol: BZW1;
  Gene Name: basic leu zipper and W2 domains 1;
  Uniprot ID:  Q7L1Q6;
  ENSP ID: ENSP00000386474
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 8337 - protein, 423 aa, Homo sapiens
  Payload ID: 1733;
  Gene Symbol: BZW1;
  Gene Name: basic leu zipper and W2 domains 1;
  Uniprot ID:  Q7L1Q6;
  ENSP ID: ENSP00000386837
MVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 8338 - protein, 294 aa, Homo sapiens
  Payload ID: 1733;
  Gene Symbol: BZW1;
  Gene Name: basic leu zipper and W2 domains 1;
  ENSP ID: ENSP00000387086
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIG

SEQ ID NO: 8339 - protein, 216 aa, Homo sapiens
  Payload ID: 1733;
  Gene Symbol: BZW1;
  Gene Name: basic leu zipper and W2 domains 1;
  ENSP ID: ENSP00000390766
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLM

SEQ ID NO: 8340 - protein, 116 aa, Homo sapiens
  Payload ID: 1733;
  Gene Symbol: BZW1;
  Gene Name: basic leu zipper and W2 domains 1;
  ENSP ID: ENSP00000393587
MVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQ

SEQ ID NO: 8341 - protein, 451 aa, Homo sapiens
  Payload ID: 1733;
  Gene Symbol: BZW1;
  Gene Name: basic leu zipper and W2 domains 1;
  Uniprot ID:  Q7L1Q6;
  ENSP ID: ENSP00000394316
MYGAPGAPAQSASVTVVRSLRRPPPQATGVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 8342 - protein, 135 aa, Homo sapiens
  Payload ID: 1733;
  Gene Symbol: BZW1;
  Gene Name: basic leu zipper and W2 domains 1;
  ENSP ID: ENSP00000395673
  MOD_RES (1)..(1): Any amino acid
XGARKELQKELQEQMSRGDPFKDIILYVKEEMKKNNIPEPVVIGIVWSSVMSTVEWNKKEELVAEQAIKHLKQYSPLLAAFTTQAEVLSEEPILKWYKDAHVAKGKSVFLEQMKKFVEWLKNAEEESESEAEEGD

SEQ ID NO: 8343 - protein, 161 aa, Homo sapiens
  Payload ID: 1733;
  Gene Symbol: BZW1;
  Gene Name: basic leu zipper and W2 domains 1;
  ENSP ID: ENSP00000407268
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANG

SEQ ID NO: 8344 - protein, 154 aa, Homo sapiens
  Payload ID: 1733;
  Gene Symbol: BZW1;
  Gene Name: basic leu zipper and W2 domains 1;
  ENSP ID: ENSP00000412072
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLT

SEQ ID NO: 8345 - protein, 419 aa, Homo sapiens
  Payload ID: 1734;
  Gene Symbol: BZW2;
  Gene Name: basic leu zipper and W2 domains 2;
  Uniprot ID:  Q9Y6E2;
  ENSP ID: ENSP00000258761
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 8346 - protein, 225 aa, Homo sapiens
  Payload ID: 1734;
  Gene Symbol: BZW2;
  Gene Name: basic leu zipper and W2 domains 2;
  ENSP ID: ENSP00000384617
MAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 8347 - protein, 343 aa, Homo sapiens
  Payload ID: 1734;
  Gene Symbol: BZW2;
  Gene Name: basic leu zipper and W2 domains 2;
  ENSP ID: ENSP00000385577
MLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 8348 - protein, 170 aa, Homo sapiens
  Payload ID: 1734;
  Gene Symbol: BZW2;
  Gene Name: basic leu zipper and W2 domains 2;
  ENSP ID: ENSP00000389183
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKPFPKQSRQSWRCCRGFCWAMAPCPPPSSPVSSPTA

SEQ ID NO: 8349 - protein, 419 aa, Homo sapiens; identical to SEQ ID NO: 8345
  Payload ID: 1734;
  Gene Symbol: BZW2;
  Gene Name: basic leu zipper and W2 domains 2;
  Uniprot ID:  Q9Y6E2;
  ENSP ID: ENSP00000397249

SEQ ID NO: 8350 - protein, 408 aa, Homo sapiens
  Payload ID: 1734;
  Gene Symbol: BZW2;
  Gene Name: basic leu zipper and W2 domains 2;
  ENSP ID: ENSP00000403481
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNA

SEQ ID NO: 8351 - protein, 161 aa, Homo sapiens
  Payload ID: 1734;
  Gene Symbol: BZW2;
  Gene Name: basic leu zipper and W2 domains 2;
  ENSP ID: ENSP00000406395
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKALRPHLLSSFSKHGWQKKMPTLLPRL

SEQ ID NO: 8352 - protein, 189 aa, Homo sapiens
  Payload ID: 1734;
  Gene Symbol: BZW2;
  Gene Name: basic leu zipper and W2 domains 2;
  ENSP ID: ENSP00000411715
MLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKIVVLFYKADVLSEEAILKWYKEAHVAKGKSVFLDQMKKFVEWLQNAEEESESEGEEN

SEQ ID NO: 8353 - protein, 274 aa, Homo sapiens
  Payload ID: 1734;
  Gene Symbol: BZW2;
  Gene Name: basic leu zipper and W2 domains 2;
  ENSP ID: ENSP00000412750
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKE

SEQ ID NO: 8354 - protein, 208 aa, Homo sapiens
  Payload ID: 1734;
  Gene Symbol: BZW2;
  Gene Name: basic leu zipper and W2 domains 2;
  ENSP ID: ENSP00000415924
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLR

SEQ ID NO: 8355 - protein, 162 aa, Homo sapiens
  Payload ID: 1734;
  Gene Symbol: BZW2;
  Gene Name: basic leu zipper and W2 domains 2;
  ENSP ID: ENSP00000416531
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNG

SEQ ID NO: 8356 - protein, 161 aa, Homo sapiens; identical to SEQ ID NO: 8351
  Payload ID: 1734;
  Gene Symbol: BZW2;
  Gene Name: basic leu zipper and W2 domains 2;
  ENSP ID: ENSP00000486454

SEQ ID NO: 8357 - protein, 400 aa, Homo sapiens
  Payload ID: 1735;
  Gene Symbol: BLZF1;
  Gene Name: basic leu zipper nuclear  factor 1;
  Uniprot ID:  Q9H2G9;
  ENSP ID: ENSP00000327541
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVKNVLEKLKNSERRLLQDKEGLSNQLRVQTEVNRELKKLLVASVGDDLQYHFERLAREKNQLILENEALGRNTAQLSEQLERMSIQCDVWRSKFLASRVMADELTNSRAALQRQNRDAHGAIQDLLSEREQFRQEMIATQKLLEELLVSLQWGREQTYSPSVQPHSTAELALTNHKLAKAVNSHLLGNVGINNQKKIPSTVEFCSTPAEKMAETVLRILDPVTCKESSPDNPFFESSPTTLLATKKNIGRFHPYTRYENITFNCCNHCRGELIAL

SEQ ID NO: 8358 - protein, 174 aa, Homo sapiens
  Payload ID: 1735;
  Gene Symbol: BLZF1;
  Gene Name: basic leu zipper nuclear  factor 1;
  Uniprot ID:  Q9H2G9;
  ENSP ID: ENSP00000356781
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVKNVLEKLKNSERRLLQDKEGLSNQLRVQTEVRRALIDKMSTTLYVWTF

SEQ ID NO: 8359 - protein, 400 aa, Homo sapiens; identical to SEQ ID NO: 8357
  Payload ID: 1735;
  Gene Symbol: BLZF1;
  Gene Name: basic leu zipper nuclear  factor 1;
  Uniprot ID:  Q9H2G9;
  ENSP ID: ENSP00000356782

SEQ ID NO: 8360 - protein, 250 aa, Homo sapiens
  Payload ID: 1735;
  Gene Symbol: BLZF1;
  Gene Name: basic leu zipper nuclear  factor 1;
  ENSP ID: ENSP00000404408
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVKNVLEKLKNSERRLLQDKEGLSNQLRVQTEVNRELKKLLVASVGDDLQYHFERLAREKNQLILENEALGRNTAQLSEQLERMSIQCDVWRSKFLASRVMADELTNSRAALQRQNRDAHGAIQDL

SEQ ID NO: 8361 - protein, 127 aa, Homo sapiens
  Payload ID: 1735;
  Gene Symbol: BLZF1;
  Gene Name: basic leu zipper nuclear  factor 1;
  ENSP ID: ENSP00000414668
MTTKNLETKVTVTSSPIRGAGDGMETEEPPKSVEVTSGVQSRKHHSLQSPWKKAVPSESPGVLQLGKMLTEKAMEVKAVRILVPKAAITHDIPNKNTKVKSLGHHKGEFLGQSEGVIEPNKELSEVK

SEQ ID NO: 8362 - protein, 125 aa, Homo sapiens
  Payload ID: 1736;
  Gene Symbol: BATF;
  Gene Name: basic leu zipper transcription factor, ATF-like;
  Uniprot ID:  Q16520;
  ENSP ID: ENSP00000286639
MPHSSDSSDSSFSRSPPPGKQDSSDDVRRVQRREKNRIAAQKSRQRQTQKADTLHLESEDLEKQNAALRKEIKQLTEELKYFTSVLNSHEPLCSVLAASTPSPPEVVYSAHAFHQPHVSSPRFQP

SEQ ID NO: 8363 - protein, 73 aa, Homo sapiens
  Payload ID: 1736;
  Gene Symbol: BATF;
  Gene Name: basic leu zipper transcription factor, ATF-like;
  ENSP ID: ENSP00000450486
MPHSSDSSDSSFSRSPPPGKQDSSDDVRRVQRREKNRIAAQKSRQRQTQKSIKKDAQVPWHRARRAGNGYFSK

SEQ ID NO: 8364 - protein, 274 aa, Homo sapiens
  Payload ID: 1737;
  Gene Symbol: BATF2;
  Gene Name: basic leu zipper transcription factor, ATF-like 2;
  Uniprot ID:  Q8N1L9;
  ENSP ID: ENSP00000301887
MHLCGGNGLLTQTDPKEQQRQLKKQKNRAAAQRSRQKHTDKADALHQQHESLEKDNLALRKEIQSLQAELAWWSRTLHVHERLCPMDCASCSAPGLLGCWDQAEGLLGPGPQGQHGCREQLELFQTPGSCYPAQPLSPGPQPHDSPSLLQCPLPSLSLGPAVVAEPPVQLSPSPLLFASHTGSSLQGSSSKLSALQPSLTAQTAPPQPLELEHPTRGKLGSSPDNPSSALGLARLQSREHKPALSAATWQGLVVDPSPHPLLAFPLLSSAQVHF

SEQ ID NO: 8365 - protein, 189 aa, Homo sapiens
  Payload ID: 1737;
  Gene Symbol: BATF2;
  Gene Name: basic leu zipper transcription factor, ATF-like 2;
  Uniprot ID:  Q8N1L9;
  ENSP ID: ENSP00000398911
MDCASCSAPGLLGCWDQAEGLLGPGPQGQHGCREQLELFQTPGSCYPAQPLSPGPQPHDSPSLLQCPLPSLSLGPAVVAEPPVQLSPSPLLFASHTGSSLQGSSSKLSALQPSLTAQTAPPQPLELEHPTRGKLGSSPDNPSSALGLARLQSREHKPALSAATWQGLVVDPSPHPLLAFPLLSSAQVHF

SEQ ID NO: 8366 - protein, 250 aa, Homo sapiens
  Payload ID: 1737;
  Gene Symbol: BATF2;
  Gene Name: basic leu zipper transcription factor, ATF-like 2;
  ENSP ID: ENSP00000434915
MAPVGKRIGGLGDTRVGGPCISQQHESLEKDNLALRKEIQSLQAELAWWSRTLHVHERLCPMDCASCSAPGLLGCWDQAEGLLGPGPQGQHGCREQLELFQTPGSCYPAQPLSPGPQPHDSPSLLQCPLPSLSLGPAVVAEPPVQLSPSPLLFASHTGSSLQGSSSKLSALQPSLTAQTAPPQPLELEHPTRGKLGSSPDNPSSALGLARLQSREHKPALSAATWQGLVVDPSPHPLLAFPLLSSAQVHF

SEQ ID NO: 8367 - protein, 155 aa, Homo sapiens
  Payload ID: 1737;
  Gene Symbol: BATF2;
  Gene Name: basic leu zipper transcription factor, ATF-like 2;
  ENSP ID: ENSP00000435640
MHLCGGNGLLTQTDPKEQQRQLKKQKNRAAAQRSRQKHTDKADALHQHESLEKDNLALRKEIQSLQAELAWWSRTLHVHERLCPMDCASCSAPGLLGCWDQAEGLLGPGPQGQHGCREQLELFQTPGSCYPAQPLSPGPQPHDSPSLLQCPLPSL

SEQ ID NO: 8368 - protein, 127 aa, Homo sapiens
  Payload ID: 1738;
  Gene Symbol: BATF3;
  Gene Name: basic leu zipper transcription factor, ATF-like 3;
  Uniprot ID:  Q9NR55;
  ENSP ID: ENSP00000243440
MSQGLPAAGSVLQRSVAAPGNQPQPQPQQQSPEDDDRKVRRREKNRVAAQRSRKKQTQKADKLHEEYESLEQENTMLRREIGKLTEELKHLTEALKEHEKMCPLLLCPMNFVPVPPRPDPVAGCLPR

SEQ ID NO: 8369 - protein, 162 aa, Homo sapiens
  Payload ID: 1739;
  Gene Symbol: BTF3;
  Gene Name: basic transcription factor 3;
  Uniprot ID:  P20290;
  ENSP ID: ENSP00000338516
MKETIMNQEKLAKLQAQVRIGGKGTARRKKKVVHRTATADDKKLQFSLKKLGVNNISGIEEVNMFTNQGTVIHFNNPKVQASLAANTFTITGHAETKQLTEMLPSILNQLGADSLTSLRRLAEALPKQSVDGKAPLATGEDDDDEVPDLVENFDEASKNEAN

SEQ ID NO: 8370 - protein, 206 aa, Homo sapiens
  Payload ID: 1739;
  Gene Symbol: BTF3;
  Gene Name: basic transcription factor 3;
  Uniprot ID:  P20290;
  ENSP ID: ENSP00000369965
MRRTGAPAQADSRGRGRARGGCPGGEATLSQPPPRGGTRGQEPQMKETIMNQEKLAKLQAQVRIGGKGTARRKKKVVHRTATADDKKLQFSLKKLGVNNISGIEEVNMFTNQGTVIHFNNPKVQASLAANTFTITGHAETKQLTEMLPSILNQLGADSLTSLRRLAEALPKQSVDGKAPLATGEDDDDEVPDLVENFDEASKNEAN

SEQ ID NO: 8371 - protein, 109 aa, Homo sapiens
  Payload ID: 1739;
  Gene Symbol: BTF3;
  Gene Name: basic transcription factor 3;
  ENSP ID: ENSP00000420978
MKETIMNQEKLAKLQAQVRIGGKVNMFTNQGTVIHFNNPKVQASLAANTFTITGHAETKQLTEMLPSILNQLGADSLTSLRRLAEALPKQSVDGKAPLATGEDDDDEVP

SEQ ID NO: 8372 - protein, 86 aa, Homo sapiens
  Payload ID: 1739;
  Gene Symbol: BTF3;
  Gene Name: basic transcription factor 3;
  ENSP ID: ENSP00000425490
  MOD_RES (1)..(1): Any amino acid
XIEEVNMFTNQGTVIHFNNPKVQASLAANTFTITGHAETKQLTEMLPSILNQLGADSLTSLRRLAEALPKQYLVENFDEASKNEAN

SEQ ID NO: 8373 - protein, 158 aa, Homo sapiens
  Payload ID: 1740;
  Gene Symbol: BTF3L4;
  Gene Name: basic transcription factor 3-like 4;
  Uniprot ID:  Q96K17;
  ENSP ID: ENSP00000360664
MNQEKLAKLQAQVRIGGKGTARRKKKVVHRTATADDKKLQSSLKKLAVNNIAGIEEVNMIKDDGTVIHFNNPKVQASLSANTFAITGHAEAKPITEMLPGILSQLGADSLTSLRKLAEQFPRQVLDSKAPKPEDIDEEDDDVPDLVENFDEASKNEAN

SEQ ID NO: 8374 - protein, 145 aa, Homo sapiens
  Payload ID: 1740;
  Gene Symbol: BTF3L4;
  Gene Name: basic transcription factor 3-like 4;
  ENSP ID: ENSP00000433418
MNQEKLAKLQAQVRIGGKGTARRKKKVVHRTATADDKKLQSSLKKLAVNNIAGIEEVNMIKDDGTVIHFNNPKVQASLSANTFAITGHAEAKPITEMLPGILSQLGADSLTSLRKLAEQFPRQVLDSKAPKPEDIDEEDDDVPGK

SEQ ID NO: 8375 - protein, 54 aa, Homo sapiens
  Payload ID: 1740;
  Gene Symbol: BTF3L4;
  Gene Name: basic transcription factor 3-like 4;
  ENSP ID: ENSP00000434611
MNQEKLAKLQAQVRIGGKVFLTNSYLFFHVGEYEYQLSYSLYFLKPKEELVVSN

SEQ ID NO: 8376 - protein, 78 aa, Homo sapiens
  Payload ID: 1740;
  Gene Symbol: BTF3L4;
  Gene Name: basic transcription factor 3-like 4;
  Uniprot ID:  Q96K17;
  ENSP ID: ENSP00000434824
MNQEKLAKLQAQVRIGGKGTARRKKKVVHRTATADDKKLQSSLKKLAVNNIAGIEESWTVKHQNQKTLMRKMMMFQIL

SEQ ID NO: 8377 - protein, 100 aa, Homo sapiens
  Payload ID: 1740;
  Gene Symbol: BTF3L4;
  Gene Name: basic transcription factor 3-like 4;
  Uniprot ID:  Q96K17;
  ENSP ID: ENSP00000436712
MIKDDGTVIHFNNPKVQASLSANTFAITGHAEAKPITEMLPGILSQLGADSLTSLRKLAEQFPRQVLDSKAPKPEDIDEEDDDVPDLVENFDEASKNEAN

SEQ ID NO: 8378 - protein, 503 aa, Homo sapiens
  Payload ID: 1741;
  Gene Symbol: BIVM;
  Gene Name: basic, immunoglobulin-like variable motif containing;
  Uniprot ID:  Q86UB2;
  ENSP ID: ENSP00000257336
MPNVAETERSNDSGNGEHKSERKSPEENLQGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKGRYQKECPQHSPLEDIKQRKVLDLRRWYCISRPQYKTSCGISSLISCWNFLYSTMGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKVGGNLHCIIAFQRLNWQRFGLWNFPFGTIRQESQPPTHAQGIAKSESEDNISKKQHGRLGRSFSASFHQDSAWKKMSSIHERRNSGYQGYSDYDGND

SEQ ID NO: 8379 - protein, 281 aa, Homo sapiens
  Payload ID: 1741;
  Gene Symbol: BIVM;
  Gene Name: basic, immunoglobulin-like variable motif containing;
  Uniprot ID:  Q86UB2;
  ENSP ID: ENSP00000412794
MGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKPTFFSSQVGGNLHCIIAFQRLNWQRFGLWNFPFGTIRQESQPPTHAQGIAKSESEDNISKKQHGRLGRSFSASFHQDSAWKKMSSIHERRNSGYQGYSDYDGND

SEQ ID NO: 8380 - protein, 385 aa, Homo sapiens
  Payload ID: 1742;
  Gene Symbol: BSG;
  Gene Name: basigin (Ok blood group);
  Uniprot ID:  P35613;
  ENSP ID: ENSP00000333769
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 8381 - protein, 269 aa, Homo sapiens
  Payload ID: 1742;
  Gene Symbol: BSG;
  Gene Name: basigin (Ok blood group);
  Uniprot ID:  P35613;
  ENSP ID: ENSP00000343809
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 8382 - protein, 205 aa, Homo sapiens
  Payload ID: 1742;
  Gene Symbol: BSG;
  Gene Name: basigin (Ok blood group);
  Uniprot ID:  P35613;
  ENSP ID: ENSP00000344707
MKQSDASPQERVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 8383 - protein, 160 aa, Homo sapiens
  Payload ID: 1742;
  Gene Symbol: BSG;
  Gene Name: basigin (Ok blood group);
  ENSP ID: ENSP00000458665
MAAALFVLLGFALLGTHGASGAEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSE

SEQ ID NO: 8384 - protein, 84 aa, Homo sapiens
  Payload ID: 1742;
  Gene Symbol: BSG;
  Gene Name: basigin (Ok blood group);
  ENSP ID: ENSP00000473393
MGTANIQLHGPPRVKAVKSSEHINEGETAMLVCKSESVPPVTDWAWYKITDSEDKALMNGSESRFFVSSSQGRSELHIENLNME

SEQ ID NO: 8385 - protein, 52 aa, Homo sapiens
  Payload ID: 1742;
  Gene Symbol: BSG;
  Gene Name: basigin (Ok blood group);
  ENSP ID: ENSP00000473528
MGTANIQLHGPPRVKAVKSSEHINEGETAMLVCKSESVPPVTDWAWYKITDS

SEQ ID NO: 8386 - protein, 176 aa, Homo sapiens
  Payload ID: 1742;
  Gene Symbol: BSG;
  Gene Name: basigin (Ok blood group);
  Uniprot ID:  P35613;
  ENSP ID: ENSP00000473664
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 8387 - protein, 189 aa, Homo sapiens
  Payload ID: 1742;
  Gene Symbol: BSG;
  Gene Name: basigin (Ok blood group);
  ENSP ID: ENSP00000478958
MAAALFVLLGFALLGTHGASGAGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 8388 - protein, 55 aa, Homo sapiens
  Payload ID: 1742;
  Gene Symbol: BSG;
  Gene Name: basigin (Ok blood group);
  ENSP ID: ENSP00000484624
MAAALFVLLGFALLGTHGASGAAGTVFTTVEDLGSKILLTCSLNDSATEQRAAPE

SEQ ID NO: 8389 - protein, 221 aa, Homo sapiens
  Payload ID: 1742;
  Gene Symbol: BSG;
  Gene Name: basigin (Ok blood group);
  ENSP ID: ENSP00000484849
MAAALFVLLGFALLGTHGASGAVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVT

SEQ ID NO: 8390 - protein, 994 aa, Homo sapiens
  Payload ID: 1743;
  Gene Symbol: BNC1;
  Gene Name: basonuclin 1;
  Uniprot ID:  Q01954;
  ENSP ID: ENSP00000307041
MRRRPPSRGGRGAARARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 8391 - protein, 987 aa, Homo sapiens
  Payload ID: 1743;
  Gene Symbol: BNC1;
  Gene Name: basonuclin 1;
  ENSP ID: ENSP00000456727
MRCRNMFFSFKASLCGCGAATAPSLTAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 8392 - protein, 993 aa, Homo sapiens
  Payload ID: 1743;
  Gene Symbol: BNC1;
  Gene Name: basonuclin 1;
  ENSP ID: ENSP00000478817
MRRRPEPGRTRGGRARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 8393 - protein, 294 aa, Homo sapiens
  Payload ID: 1744;
  Gene Symbol: BNC2;
  Gene Name: basonuclin 2;
  ENSP ID: ENSP00000370041
MQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVS

SEQ ID NO: 8394 - protein, 1032 aa, Homo sapiens
  Payload ID: 1744;
  Gene Symbol: BNC2;
  Gene Name: basonuclin 2;
  ENSP ID: ENSP00000370042
MAHLGPTPPPHSLNYKSEDRLSEQDWPAYFKVPCCGVDTSQIEAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 8395 - protein, 1099 aa, Homo sapiens
  Payload ID: 1744;
  Gene Symbol: BNC2;
  Gene Name: basonuclin 2;
  Uniprot ID:  Q6ZN30;
  ENSP ID: ENSP00000370047
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 8396 - protein, 327 aa, Homo sapiens
  Payload ID: 1744;
  Gene Symbol: BNC2;
  Gene Name: basonuclin 2;
  ENSP ID: ENSP00000392212
PSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLRRGNSNRPGTCCLHTGDSLEESVIVRISCKRLES

SEQ ID NO: 8397 - protein, 860 aa, Homo sapiens
  Payload ID: 1744;
  Gene Symbol: BNC2;
  Gene Name: basonuclin 2;
  ENSP ID: ENSP00000408370
SEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLLPT

SEQ ID NO: 8398 - protein, 903 aa, Homo sapiens
  Payload ID: 1744;
  Gene Symbol: BNC2;
  Gene Name: basonuclin 2;
  Uniprot ID:  Q6ZN30;
  ENSP ID: ENSP00000431516
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRYWEKSNEQNGLLVSWGETLSSLK

SEQ ID NO: 8399 - protein, 729 aa, Homo sapiens
  Payload ID: 1744;
  Gene Symbol: BNC2;
  Gene Name: basonuclin 2;
  ENSP ID: ENSP00000444640
MLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLLPT

SEQ ID NO: 8400 - protein, 121 aa, Homo sapiens
  Payload ID: 1744;
  Gene Symbol: BNC2;
  Gene Name: basonuclin 2;
  ENSP ID: ENSP00000473935
MQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQ

SEQ ID NO: 8401 - protein, 245 aa, Homo sapiens
  Payload ID: 1744;
  Gene Symbol: BNC2;
  Gene Name: basonuclin 2;
  ENSP ID: ENSP00000474045
MQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLL

SEQ ID NO: 8402 - protein, 109 aa, Homo sapiens
  Payload ID: 1744;
  Gene Symbol: BNC2;
  Gene Name: basonuclin 2;
  ENSP ID: ENSP00000474468
SEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHETLKSCLQ

SEQ ID NO: 8403 - protein, 164 aa, Homo sapiens
  Payload ID: 1744;
  Gene Symbol: BNC2;
  Gene Name: basonuclin 2;
  ENSP ID: ENSP00000474647
MSEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHIL

SEQ ID NO: 8404 - protein, 43 aa, Homo sapiens
  Payload ID: 1744;
  Gene Symbol: BNC2;
  Gene Name: basonuclin 2;
  ENSP ID: ENSP00000474832
MAIRCTLVNCTCECFQPGKINLRTCDQCKHGWVAHETLKSCLQ

SEQ ID NO: 8405 - protein, 40 aa, Homo sapiens
  Payload ID: 1744;
  Gene Symbol: BNC2;
  Gene Name: basonuclin 2;
  ENSP ID: ENSP00000477717
MQFGTRTTTAEPGFMGTWQNADTNLLFRMSQQAIRCTLVN

SEQ ID NO: 8406 - protein, 40 aa, Homo sapiens; identical to SEQ ID NO: 8405
  Payload ID: 1744;
  Gene Symbol: BNC2;
  Gene Name: basonuclin 2;
  ENSP ID: ENSP00000482793

SEQ ID NO: 8407 - protein, 3926 aa, Homo sapiens
  Payload ID: 1745;
  Gene Symbol: BSN;
  Gene Name: bassoon presynaptic cytomatrix prt;
  Uniprot ID:  Q9UPA5;
  ENSP ID: ENSP00000296452
MGNEVSLEGGAGDGPLPPGGAGPGPGPGPGPGAGKPPSAPAGGGQLPAAGAARSTAVPPVPGPGPGPGPGPGPGSTSRRLDPKEPLGNQRAASPTPKQASATTPGHESPRETRAQGPAGQEADGPRRTLQVDSRTQRSGRSPSVSPDRGSTPTSPYSVPQIAPLPSSTLCPICKTSDLTSTPSQPNFNTCTQCHNKVCNQCGFNPNPHLTQVKEWLCLNCQMQRALGMDMTTAPRSKSQQQLHSPALSPAHSPAKQPLGKPDQERSRGPGGPQPGSRQAETARATSVPGPAQAAAPPEVGRVSPQPPQPTKPSTAEPRPPAGEAPAKSATAVPAGLGATEQTQEGLTGKLFGLGASLLTQASTLMSVQPEADTQGQPAPSKGTPKIVFNDASKEAGPKPLGSGPGPGPAPGAKTEPGARMGPGSGPGALPKTGGTTSPKHGRAEHQAASKAAAKPKTMPKERAICPLCQAELNVGSKSPANYNTCTTCRLQVCNLCGFNPTPHLVEKTEWLCLNCQTKRLLEGSLGEPTPLPPPTSQQPPVGAPHRASGTSPLKQKGPQGLGQPSGPLPAKASPLSTKASPLPSKASPQAKPLRASEPSKTPSSVQEKKTRVPTKAEPMPKPPPETTPTPATPKVKSGVRRAEPATPVVKAVPEAPKGGEAEDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDEELEDILEEDEDSAEWRRRREQQDTAESSDDFGSQLRHDYVEDSSEGGLSPLPPQPPARAAELTDEDFMRRQILEMSAEEDNLEEDDTATSGRGLAKHGTQKGGPRPRPEPSQEPAALPKRRLPHNATTGYEELLPEGGSAEATDGSGTLQGGLRRFKTIELNSTGSYGHELDLGQGPDPSLDREPELEMESLTGSPEDRSRGEHSSTLPASTPSYTSGTSPTSLSSLEEDSDSSPSRRQRLEEAKQQRKARHRSHGPLLPTIEDSSEEEELREEEELLREQEKMREVEQQRIRSTARKTRRDKEELRAQRRRERSKTPPSNLSPIEDASPTEELRQAAEMEELHRSSCSEYSPSPSLDSEAEALDGGPSRLYKSGSEYNLPTFMSLYSPTETPSGSSTTPSSGRPLKSAEEAYEEMMRKAELLQRQQGQAAGARGPHGGPSQPTGPRGLGSFEYQDTTDREYGQAAQPAAEGTPASLGAAVYEEILQTSQSIVRMRQASSRDLAFAEDKKKEKQFLNAESAYMDPMKQNGGPLTPGTSPTQLAAPVSFSTPTSSDSSGGRVIPDVRVTQHFAKETQDPLKLHSSPASPSSASKEIGMPFSQGPGTPATTAVAPCPAGLPRGYMTPASPAGSERSPSPSSTAHSYGHSPTTANYGSQTEDLPQAPSGLAAAGRAAREKPLSASDGEGGTPQPSRAYSYFASSSPPLSPSSPSESPTFSPGKMGPRATAEFSTQTPSPAPASDMPRSPGAPTPSPMVAQGTQTPHRPSTPRLVWQESSQEAPFMVITLASDASSQTRMVHASASTSPLCSPTETQPTTHGYSQTTPPSVSQLPPEPPGPPGFPRVPSAGADGPLALYGWGALPAENISLCRISSVPGTSRVEPGPRTPGTAVVDLRTAVKPTPIILTDQGMDLTSLAVEARKYGLALDPIPGRQSTAVQPLVINLNAQEHTFLATATTVSITMASSVFMAQQKQPVVYGDPYQSRLDFGQGGGSPVCLAQVKQVEQAVQTAPYRSGPRGRPREAKFARYNLPNQVAPLARRDVLITQMGTAQSIGLKPGPVPEPGAEPHRATPAELRSHALPGARKPHTVVVQMGEGTAGTVTTLLPEEPAGALDLTGMRPESQLACCDMVYKLPFGSSCTGTFHPAPSVPEKSMADAAPPGQSSSPFYGPRDPEPPEPPTYRAQGVVGPGPHEEQRPYPQGLPGRLYSSMSDTNLAEAGLNYHAQRIGQLFQGPGRDSAMDLSSLKHSYSLGFADGRYLGQGLQYGSVTDLRHPTDLLAHPLPMRRYSSVSNIYSDHRYGPRGDAVGFQEASLAQYSATTAREISRMCAALNSMDQYGGRHGSGGGGPDLVQYQPQHGPGLSAPQSLVPLRPGLLGNPTFPEGHPSPGNLAQYGPAAGQGTAVRQLLPSTATVRAADGMIYSTINTPIAATLPITTQPASVLRPMVRGGMYRPYASGGITAVPLTSLTRVPMIAPRVPLGPTGLYRYPAPSRFPIASSVPPAEGPVYLGKPAAAKAPGAGGPSRPEMPVGAAREEPLPTTTPAAIKEAAGAPAPAPLAGQKPPADAAPGGGSGALSRPGFEKEEASQEERQRKQQEQLLQLERERVELEKLRQLRLQEELERERVELQRHREEEQLLVQRELQELQTIKHHVLQQQQEERQAQFALQREQLAQQRLQLEQIQQLQQQLQQQLEEQKQRQKAPFPAACEAPGRGPPLAAAELAQNGQYWPPLTHAAFIAMAGPEGLGQPREPVLHRGLPSSASDMSLQTEEQWEASRSGIKKRHSMPRLRDACELESGTEPCVVRRIADSSVQTDDEDGESRYLLSRRRRARRSADCSVQTDDEDSAEWEQPVRRRRSRLPRHSDSGSDSKHDATASSSSAAATVRAMSSVGIQTISDCSVQTEPDQLPRVSPAIHITAATDPKVEIVRYISAPEKTGRGESLACQTEPDGQAQGVAGPQLVGPTAISPYLPGIQIVTPGPLGRFEKKKPDPLEIGYQAHLPPESLSQLVSRQPPKSPQVLYSPVSPLSPHRLLDTSFASSERLNKAHVSPQKHFTADSALRQQTLPRPMKTLQRSLSDPKPLSPTAEESAKERFSLYQHQGGLGSQVSALPPNSLVRKVKRTLPSPPPEEAHLPLAGQASPQLYAASLLQRGLTGPTTVPATKASLLRELDRDLRLVEHESTKLRKKQAELDEEEKEIDAKLKYLELGITQRKESLAKDRGGRDYPPLRGLGEHRDYLSDSELNQLRLQGCTTPAGQFVDFPATAAAPATPSGPTAFQQPRFQPPAPQYSAGSGGPTQNGFPAHQAPTYPGPSTYPAPAFPPGASYPAEPGLPNQQAFRPTGHYAGQTPMPTTQSTLFPVPADSRAPLQKPRQTSLADLEQKVPTNYEVIASPVVPMSSAPSETSYSGPAVSSGYEQGKVPEVPRAGDRGSVSQSPAPTYPSDSHYTSLEQNVPRNYVMIDDISELTKDSTSTAPDSQRLEPLGPGSSGRPGKEPGEPGVLDGPTLPCCYARGEEESEEDSYDPRGKGGHLRSMESNGRPASTHYYGDSDYRHGARVEKYGPGPMGPKHPSKSLAPAAISSKRSKHRKQGMEQKISKFSPIEEAKDVESDLASYPPPAVSSSLVSRGRKFQDEITYGLKKNVYEQQKYYGMSSRDAVEDDRIYGGSSRSRAPSAYSGEKLSSHDFSGWGKGYEREREAVERLQKAGPKPSSLSMAHSRVRPPMRSQASEEESPVSPLGRPRPAGGPLPPGGDTCPQFCSSHSMPDVQEHVKDGPRAHAYKREEGYILDDSHCVVSDSEAYHLGQEETDWFDKPRDARSDRFRHHGGHAVSSSSQKRGPARHSYHDYDEPPEEGLWPHDEGGPGRHASAKEHRHGDHGRHSGRHTGEEPGRRAAKPHARDLGRHEARPHSQPSSAPAMPKKGQPGYPSSAEYSQPSRASSAYHHASDSKKGSRQAHSGPAALQSKAEPQAQPQLQGRQAAPGPQQSQSPSSRQIPSGAASRQPQTQQQQQGLGLQPPQQALTQARLQQQSQPTTRGSAPAASQPAGKPQPGPSTATGPQPAGPPRAEQTNGSKGTAKAPQQGRAPQAQPAPGPGPAGVKAGARPGGTPGAPAGQPGADGESVFSKILPGGAAEQAGKLTEAVSAFGKKFSSFW

SEQ ID NO: 8408 - protein, 402 aa, Homo sapiens
  Payload ID: 1746;
  Gene Symbol: BSPRY;
  Gene Name: B-box and SPRY domain containing;
  Uniprot ID:  Q5W0U4;
  ENSP ID: ENSP00000363298
MSAEGAEPGPGSGSGPGPGPLCPEHGQALSWFCGSERRPVCAACAGLGGRCRGHRIRRAEERAEELRNKIVDQCERLQLQSAAITKYVADVLPGKNQRAVSMASAARELVIQRLSLVRSLCESEEQRLLEQVHGEEERAHQSILTQRVHWAEALQKLDTIRTGLVGMLTHLDDLQLIQKEQEIFERTEEAEGILDPQESEMLNFNEKCTRSPLLTQLWATAVLGSLSGTEDIRIDERTVSPFLQLSDDRKTLTFSTKKSKACADGPERFDHWPNALAATSFQNGLHAWMVNVQNSCAYKVGVASGHLPRKGSGSDCRLGHNAFSWVFSRYDQEFRFSHNGQHEPLGLLRGPAQLGVVLDLQVQELLFYEPASGTVLCAHHVSFPGPLFPVFAVADQTISIVR

SEQ ID NO: 8409 - protein, 70 aa, Homo sapiens
  Payload ID: 1747;
  Gene Symbol: BBIP1;
  Gene Name: BBSome interacting prt 1;
  Uniprot ID:  A8MTZ0;
  ENSP ID: ENSP00000431936
MAEVKSMFREVLPKQGPLFVEDIMTMVLCKPKLLPLKSLTLEKLEKMHQAAQNTIRQQEMAEKDQRQITH

SEQ ID NO: 8410 - protein, 67 aa, Homo sapiens
  Payload ID: 1747;
  Gene Symbol: BBIP1;
  Gene Name: BBSome interacting prt 1;
  Uniprot ID:  A8MTZ0;
  ENSP ID: ENSP00000432274
MLKAAAKRPELSGPLFVEDIMTMVLCKPKLLPLKSLTLEKLEKMHQAAQNTIRQQEMAEKDQRQITH

SEQ ID NO: 8411 - protein, 70 aa, Homo sapiens; identical to SEQ ID NO: 8409
  Payload ID: 1747;
  Gene Symbol: BBIP1;
  Gene Name: BBSome interacting prt 1;
  Uniprot ID:  A8MTZ0;
  ENSP ID: ENSP00000432849

SEQ ID NO: 8412 - protein, 103 aa, Homo sapiens
  Payload ID: 1747;
  Gene Symbol: BBIP1;
  Gene Name: BBSome interacting prt 1;
  Uniprot ID:  A8MTZ0;
  ENSP ID: ENSP00000433157
MLKAAAKRPELSGLLKFNNYGILSESPLTSQRTTWLLYQSPSFIPGFAYPSRCLKTIGGVYKQARKKHYIQQLRYGRSEVNVPGSSSKARATVCGRYNDNGAV

SEQ ID NO: 8413 - protein, 45 aa, Homo sapiens
  Payload ID: 1747;
  Gene Symbol: BBIP1;
  Gene Name: BBSome interacting prt 1;
  ENSP ID: ENSP00000435795
MLKAAAKRPELSGKNTISNNSDMAEVKSMFREVLPKQEKGSQCVA

SEQ ID NO: 8414 - protein, 92 aa, Homo sapiens
  Payload ID: 1747;
  Gene Symbol: BBIP1;
  Gene Name: BBSome interacting prt 1;
  Uniprot ID:  A8MTZ0;
  ENSP ID: ENSP00000436622
MLKAAAKRPELSGKNTISNNSDMAEVKSMFREVLPKQGPLFVEDIMTMVLCKPKLLPLKSLTLEKLEKMHQAAQNTIRQQEMAEKDQRQITH

SEQ ID NO: 8415 - protein, 92 aa, Homo sapiens; identical to SEQ ID NO: 8414
  Payload ID: 1747;
  Gene Symbol: BBIP1;
  Gene Name: BBSome interacting prt 1;
  Uniprot ID:  A8MTZ0;
  ENSP ID: ENSP00000474675

SEQ ID NO: 8416 - protein, 419 aa, Homo sapiens
  Payload ID: 1748;
  Gene Symbol: BCS1L;
  Gene Name: BC1 (ubiquinol-cytochrome c reductase) synthesis-like;
  Uniprot ID:  Q9Y276;
  ENSP ID: ENSP00000352219
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 8417 - protein, 419 aa, Homo sapiens; identical to SEQ ID NO: 8416
  Payload ID: 1748;
  Gene Symbol: BCS1L;
  Gene Name: BC1 (ubiquinol-cytochrome c reductase) synthesis-like;
  Uniprot ID:  Q9Y276;
  ENSP ID: ENSP00000375957

SEQ ID NO: 8418 - protein, 419 aa, Homo sapiens; identical to SEQ ID NO: 8416
  Payload ID: 1748;
  Gene Symbol: BCS1L;
  Gene Name: BC1 (ubiquinol-cytochrome c reductase) synthesis-like;
  Uniprot ID:  Q9Y276;
  ENSP ID: ENSP00000375958

SEQ ID NO: 8419 - protein, 419 aa, Homo sapiens; identical to SEQ ID NO: 8416
  Payload ID: 1748;
  Gene Symbol: BCS1L;
  Gene Name: BC1 (ubiquinol-cytochrome c reductase) synthesis-like;
  Uniprot ID:  Q9Y276;
  ENSP ID: ENSP00000375959

SEQ ID NO: 8420 - protein, 121 aa, Homo sapiens
  Payload ID: 1748;
  Gene Symbol: BCS1L;
  Gene Name: BC1 (ubiquinol-cytochrome c reductase) synthesis-like;
  ENSP ID: ENSP00000389402
  MOD_RES (1)..(1): Any amino acid
XIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRHLP

SEQ ID NO: 8421 - protein, 76 aa, Homo sapiens
  Payload ID: 1748;
  Gene Symbol: BCS1L;
  Gene Name: BC1 (ubiquinol-cytochrome c reductase) synthesis-like;
  ENSP ID: ENSP00000391007
MPLSDFILALKDNPYFGAGFGLVGVGTALALARKGVQLGLVAFRRHYMITLEVPARDRSYAWLLSWLTRHSTRTQH

SEQ ID NO: 8422 - protein, 206 aa, Homo sapiens
  Payload ID: 1748;
  Gene Symbol: BCS1L;
  Gene Name: BC1 (ubiquinol-cytochrome c reductase) synthesis-like;
  ENSP ID: ENSP00000395440
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQ

SEQ ID NO: 8423 - protein, 110 aa, Homo sapiens
  Payload ID: 1748;
  Gene Symbol: BCS1L;
  Gene Name: BC1 (ubiquinol-cytochrome c reductase) synthesis-like;
  ENSP ID: ENSP00000397293
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRG

SEQ ID NO: 8424 - protein, 206 aa, Homo sapiens; identical to SEQ ID NO: 8422
  Payload ID: 1748;
  Gene Symbol: BCS1L;
  Gene Name: BC1 (ubiquinol-cytochrome c reductase) synthesis-like;
  ENSP ID: ENSP00000398957

SEQ ID NO: 8425 - protein, 419 aa, Homo sapiens; identical to SEQ ID NO: 8416
  Payload ID: 1748;
  Gene Symbol: BCS1L;
  Gene Name: BC1 (ubiquinol-cytochrome c reductase) synthesis-like;
  Uniprot ID:  Q9Y276;
  ENSP ID: ENSP00000404999

SEQ ID NO: 8426 - protein, 419 aa, Homo sapiens; identical to SEQ ID NO: 8416
  Payload ID: 1748;
  Gene Symbol: BCS1L;
  Gene Name: BC1 (ubiquinol-cytochrome c reductase) synthesis-like;
  Uniprot ID:  Q9Y276;
  ENSP ID: ENSP00000406494

SEQ ID NO: 8427 - protein, 150 aa, Homo sapiens
  Payload ID: 1748;
  Gene Symbol: BCS1L;
  Gene Name: BC1 (ubiquinol-cytochrome c reductase) synthesis-like;
  ENSP ID: ENSP00000412729
MQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLL

SEQ ID NO: 8428 - protein, 419 aa, Homo sapiens; identical to SEQ ID NO: 8416
  Payload ID: 1748;
  Gene Symbol: BCS1L;
  Gene Name: BC1 (ubiquinol-cytochrome c reductase) synthesis-like;
  Uniprot ID:  Q9Y276;
  ENSP ID: ENSP00000413908

SEQ ID NO: 8429 - protein, 201 aa, Homo sapiens
  Payload ID: 1748;
  Gene Symbol: BCS1L;
  Gene Name: BC1 (ubiquinol-cytochrome c reductase) synthesis-like;
  ENSP ID: ENSP00000416169
  MOD_RES (1)..(1): Any amino acid
XEAFLTDVATCFMGPLVAERAVLSLAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 8430 - protein, 292 aa, Homo sapiens
  Payload ID: 1749;
  Gene Symbol: BCDIN3D;
  Gene Name: BCDIN3 domain containing;
  Uniprot ID:  Q7Z5W3;
  ENSP ID: ENSP00000335201
MAVPTELDGGSVKETAAEEESRVLAPGAAPFGNFPHYSRFHPPEQRLRLLPPELLRQLFPESPENGPILGLDVGCNSGDLSVALYKHFLSLPDGETCSDASREFRLLCCDIDPVLVKRAEKECPFPDALTFITLDFMNQRTRKVLLSSFLSQFGRSVFDIGFCMSITMWIHLNHGDHGLWEFLAHLSSLCHYLLVEPQPWKCYRAAARRLRKLGLHDFDHFHSLAIRGDMPNQIVQILTQDHGMELICCFGNTSWDRSLLLFRAKQTIETHPIPESLIEKGKEKNRLSFQKQ

SEQ ID NO: 8431 - protein, 179 aa, Homo sapiens
  Payload ID: 1750;
  Gene Symbol: BLACE;
  Gene Name: B-cell acute lymphoblastic leukemia expressed;
  Uniprot ID:  A4D250;
  ENSP ID: ENSP00000367360
MMKDIIPASSWASEESTDLQNGSFPLSVAPRSEFPRRRALEDWLLSVFLADQAESEGQLVLERVRDTPPPVTSPRGDGICVSRGKAPSSPGGSTHAWLYLTRHFPWSPFPHGGWTDTSEPCVLETLGGSSLAALRGNSLWVQSSGACAFCVYESLIEQSLPNERFEELLLGPSPGEVMK

SEQ ID NO: 8432 - protein, 179 aa, Homo sapiens; identical to SEQ ID NO: 8431
  Payload ID: 1750;
  Gene Symbol: BLACE;
  Gene Name: B-cell acute lymphoblastic leukemia expressed;
  Uniprot ID:  A4D250;
  ENSP ID: ENSP00000484754

SEQ ID NO: 8433 - protein, 233 aa, Homo sapiens
  Payload ID: 1751;
  Gene Symbol: BCL10;
  Gene Name: B-cell CLL/lymphoma 10;
  Uniprot ID:  O95999;
  ENSP ID: ENSP00000359612
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKGLKCSSCEPFPDGATNNLSRSNSDESNFSEKLRASTVMYHPEGESSTTPFFSTNSSLNLPVLEVGRTENTIFSSTTLPRPGDPGAPPLPPDLQLEEEGTCANSSEMFLPLRSRTVSRQ

SEQ ID NO: 8434 - protein, 156 aa, Homo sapiens
  Payload ID: 1751;
  Gene Symbol: BCL10;
  Gene Name: B-cell CLL/lymphoma 10;
  ENSP ID: ENSP00000480561
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKDGATNNLSRSNSDESNFSEKLRASTVMYHPEGESSTTPFFY

SEQ ID NO: 8435 - protein, 835 aa, Homo sapiens
  Payload ID: 1752;
  Gene Symbol: BCL11A;
  Gene Name: B-cell CLL/lymphoma 11A (zinc finger prt);
  Uniprot ID:  Q9H165;
  ENSP ID: ENSP00000338774
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 8436 - protein, 773 aa, Homo sapiens
  Payload ID: 1752;
  Gene Symbol: BCL11A;
  Gene Name: B-cell CLL/lymphoma 11A (zinc finger prt);
  Uniprot ID:  Q9H165;
  ENSP ID: ENSP00000349300
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCSSHTPIRRSTQRAQDVWQFSDGSSRALKF

SEQ ID NO: 8437 - protein, 801 aa, Homo sapiens
  Payload ID: 1752;
  Gene Symbol: BCL11A;
  Gene Name: B-cell CLL/lymphoma 11A (zinc finger prt);
  Uniprot ID:  Q9H165;
  ENSP ID: ENSP00000351307
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAGKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 8438 - protein, 243 aa, Homo sapiens
  Payload ID: 1752;
  Gene Symbol: BCL11A;
  Gene Name: B-cell CLL/lymphoma 11A (zinc finger prt);
  Uniprot ID:  Q9H165;
  ENSP ID: ENSP00000352648
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 8439 - protein, 142 aa, Homo sapiens
  Payload ID: 1752;
  Gene Symbol: BCL11A;
  Gene Name: B-cell CLL/lymphoma 11A (zinc finger prt);
  ENSP ID: ENSP00000487844
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAAQTELEDVFVYLMV

SEQ ID NO: 8440 - protein, 191 aa, Homo sapiens
  Payload ID: 1752;
  Gene Symbol: BCL11A;
  Gene Name: B-cell CLL/lymphoma 11A (zinc finger prt);
  ENSP ID: ENSP00000488390
MNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 8441 - protein, 17 aa, Homo sapiens
  Payload ID: 1752;
  Gene Symbol: BCL11A;
  Gene Name: B-cell CLL/lymphoma 11A (zinc finger prt);
  ENSP ID: ENSP00000488636
  MOD_RES (1)..(1): Any amino acid
XKKWHSDRVLNNDIKTE

SEQ ID NO: 8442 - protein, 167 aa, Homo sapiens
  Payload ID: 1752;
  Gene Symbol: BCL11A;
  Gene Name: B-cell CLL/lymphoma 11A (zinc finger prt);
  ENSP ID: ENSP00000488886
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAGNPRGSSEKSPGCQCKGPALSPRRPSGKCTGLQLFPRPL

SEQ ID NO: 8443 - protein, 823 aa, Homo sapiens
  Payload ID: 1753;
  Gene Symbol: BCL11B;
  Gene Name: B-cell CLL/lymphoma 11B (zinc finger prt);
  Uniprot ID:  Q9C0K0;
  ENSP ID: ENSP00000280435
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 8444 - protein, 894 aa, Homo sapiens
  Payload ID: 1753;
  Gene Symbol: BCL11B;
  Gene Name: B-cell CLL/lymphoma 11B (zinc finger prt);
  Uniprot ID:  Q9C0K0;
  ENSP ID: ENSP00000349723
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGPCRPAQLPAVAPIAASSHPHSSVITSPLRALGALPPCLPLPCCSARPVSGDGTQGEGQTEAPFGCQCQLSGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 8445 - protein, 700 aa, Homo sapiens
  Payload ID: 1753;
  Gene Symbol: BCL11B;
  Gene Name: B-cell CLL/lymphoma 11B (zinc finger prt);
  ENSP ID: ENSP00000387419
MSRRKQGNPQHLSQRELITRKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 8446 - protein, 239 aa, Homo sapiens
  Payload ID: 1754;
  Gene Symbol: BCL2;
  Gene Name: B-cell CLL/lymphoma 2;
  Uniprot ID:  P10415;
  ENSP ID: ENSP00000329623
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 8447 - protein, 239 aa, Homo sapiens; identical to SEQ ID NO: 8446
  Payload ID: 1754;
  Gene Symbol: BCL2;
  Gene Name: B-cell CLL/lymphoma 2;
  Uniprot ID:  P10415;
  ENSP ID: ENSP00000381185

SEQ ID NO: 8448 - protein, 205 aa, Homo sapiens
  Payload ID: 1754;
  Gene Symbol: BCL2;
  Gene Name: B-cell CLL/lymphoma 2;
  Uniprot ID:  P10415;
  ENSP ID: ENSP00000466417
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWVGALGDVSLG

SEQ ID NO: 8449 - protein, 454 aa, Homo sapiens
  Payload ID: 1755;
  Gene Symbol: BCL3;
  Gene Name: B-cell CLL/lymphoma 3;
  Uniprot ID:  P20749;
  ENSP ID: ENSP00000164227
MPRCPAGAMDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 8450 - protein, 308 aa, Homo sapiens
  Payload ID: 1755;
  Gene Symbol: BCL3;
  Gene Name: B-cell CLL/lymphoma 3;
  ENSP ID: ENSP00000393731
  MOD_RES (1)..(1): Any amino acid
XEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVSRGSCGHAPCTRVSAGWLQVIDILRGKATRPASTSQPDPSPDRSANTSPESSSRLSSNGLLSASPSSSPS

SEQ ID NO: 8451 - protein, 706 aa, Homo sapiens
  Payload ID: 1756;
  Gene Symbol: BCL6;
  Gene Name: B-cell CLL/lymphoma 6;
  Uniprot ID:  P41182;
  ENSP ID: ENSP00000232014
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 8452 - protein, 706 aa, Homo sapiens; identical to SEQ ID NO: 8451
  Payload ID: 1756;
  Gene Symbol: BCL6;
  Gene Name: B-cell CLL/lymphoma 6;
  Uniprot ID:  P41182;
  ENSP ID: ENSP00000384371

SEQ ID NO: 8453 - protein, 55 aa, Homo sapiens
  Payload ID: 1756;
  Gene Symbol: BCL6;
  Gene Name: B-cell CLL/lymphoma 6;
  ENSP ID: ENSP00000398014
MASPADSCIQFTRHASDVLLNLNRLRSRDILTDVVIVVSREQFRAHKTVLMACRS

SEQ ID NO: 8454 - protein, 650 aa, Homo sapiens
  Payload ID: 1756;
  Gene Symbol: BCL6;
  Gene Name: B-cell CLL/lymphoma 6;
  Uniprot ID:  P41182;
  ENSP ID: ENSP00000413122
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 8455 - protein, 104 aa, Homo sapiens
  Payload ID: 1756;
  Gene Symbol: BCL6;
  Gene Name: B-cell CLL/lymphoma 6;
  ENSP ID: ENSP00000414455
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMA

SEQ ID NO: 8456 - protein, 121 aa, Homo sapiens
  Payload ID: 1756;
  Gene Symbol: BCL6;
  Gene Name: B-cell CLL/lymphoma 6;
  ENSP ID: ENSP00000415574
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTC

SEQ ID NO: 8457 - protein, 650 aa, Homo sapiens; identical to SEQ ID NO: 8454
  Payload ID: 1756;
  Gene Symbol: BCL6;
  Gene Name: B-cell CLL/lymphoma 6;
  Uniprot ID:  P41182;
  ENSP ID: ENSP00000479784

SEQ ID NO: 8458 - protein, 479 aa, Homo sapiens
  Payload ID: 1757;
  Gene Symbol: BCL6B;
  Gene Name: B-cell CLL/lymphoma 6, member B;
  Uniprot ID:  Q8N143;
  ENSP ID: ENSP00000293805
MGSPAAPEGALGYVREFTRHSSDVLGNLNELRLRGILTDVTLLVGGQPLRAHKAVLIACSGFFYSIFRGRAGVGVDVLSLPGGPEARGFAPLLDFMYTSRLRLSPATAPAVLAAATYLQMEHVVQACHRFIQASYEPLGISLRPLEAEPPTPPTAPPPGSPRRSEGHPDPPTESRSCSQGPPSPASPDPKACNWKKYKYIVLNSQASQAGSLVGERSSGQPCPQARLPSGDEASSSSSSSSSSSEEGPIPGPQSRLSPTAATVQFKCGAPASTPYLLTSQAQDTSGSPSERARPLPGSEFFSCQNCEAVAGCSSGLDSLVPGDEDKPYKCQLCRSSFRYKGNLASHRTVHTGEKPYHCSICGARFNRPANLKTHSRIHSGEKPYKCETCGSRFVQVAHLRAHVLIHTGEKPYPCPTCGTRFRHLQTLKSHVRIHTGEKPYHCDPCGLHFRHKSQLRLHLRQKHGAATNTKVHYHILGGP

SEQ ID NO: 8459 - protein, 135 aa, Homo sapiens
  Payload ID: 1757;
  Gene Symbol: BCL6B;
  Gene Name: B-cell CLL/lymphoma 6, member B;
  ENSP ID: ENSP00000445010
CSSGLDSLVPGDEDKPYKCQLCRSSFRYKGNLASHRTVHTGEKPYHCSICGARFNRPANLKTHSRIHSGEKPYKCETCGSRFVQVAHLRAHVLIHTGEKPYPCPTCGTRFRHLQTLKSHVRIHTGEKPYHEPVTS

SEQ ID NO: 8460 - protein, 133 aa, Homo sapiens
  Payload ID: 1757;
  Gene Symbol: BCL6B;
  Gene Name: B-cell CLL/lymphoma 6, member B;
  ENSP ID: ENSP00000460071
MGSPAAPEGALGYVREFTRHSSDVLGNLNELRLRGILTDVTLLVGGQPLRAHKAVLIACSGFFYSIFRGRAGVGVDVLSLPGGPEARGFAPLLDFMYTSRLRLSPATAPAVLAAATYLQMEHVVQACHRFIQA

SEQ ID NO: 8461 - protein, 111 aa, Homo sapiens
  Payload ID: 1757;
  Gene Symbol: BCL6B;
  Gene Name: B-cell CLL/lymphoma 6, member B;
  ENSP ID: ENSP00000460282
MGSPAAPEGALGYVREFTRHSSDVLGNLNELRLRGILTDVTLLVGGQPLRAHKAVLIACSGFFYSIFRGRAGVGVDVLSLPGGPEARGFAPLLDFMYTSRLRLSPATAPAV

SEQ ID NO: 8462 - protein, 210 aa, Homo sapiens
  Payload ID: 1758;
  Gene Symbol: BCL7A;
  Gene Name: B-cell CLL/lymphoma 7A;
  Uniprot ID:  Q4VC05;
  ENSP ID: ENSP00000261822
MSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQDLEGVPPSKKMKLEASQQNSEEM

SEQ ID NO: 8463 - protein, 231 aa, Homo sapiens
  Payload ID: 1758;
  Gene Symbol: BCL7A;
  Gene Name: B-cell CLL/lymphoma 7A;
  Uniprot ID:  Q4VC05;
  ENSP ID: ENSP00000445868
MSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQVPRSRSQRGSQIGREPIGLSGDLEGVPPSKKMKLEASQQNSEEM

SEQ ID NO: 8464 - protein, 231 aa, Homo sapiens; identical to SEQ ID NO: 8463
  Payload ID: 1758;
  Gene Symbol: BCL7A;
  Gene Name: B-cell CLL/lymphoma 7A;
  ENSP ID: ENSP00000489010

SEQ ID NO: 8465 - protein, 210 aa, Homo sapiens; identical to SEQ ID NO: 8462
  Payload ID: 1758;
  Gene Symbol: BCL7A;
  Gene Name: B-cell CLL/lymphoma 7A;
  ENSP ID: ENSP00000489305

SEQ ID NO: 8466 - protein, 202 aa, Homo sapiens
  Payload ID: 1759;
  Gene Symbol: BCL7B;
  Gene Name: B-cell CLL/lymphoma 7B;
  Uniprot ID:  Q9BQE9;
  ENSP ID: ENSP00000223368
MSGRSVRAETRSRAKDDIKKVMAAIEKVRKWEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 8467 - protein, 145 aa, Homo sapiens
  Payload ID: 1759;
  Gene Symbol: BCL7B;
  Gene Name: B-cell CLL/lymphoma 7B;
  Uniprot ID:  Q9BQE9;
  ENSP ID: ENSP00000393230
MSGRSVRAETRSRAKDDIKKVMAAIEKVRKWEKKWVTVGDTSLRIFKWVPVTDSKEKEKSKSNSSAAREPNGFPSDASANSSLLLEFQEPSLPSSEVADEPPTLTKEEPVPLETQVVEEEEDSGAPPLKRFCVDQPTVPQTASES

SEQ ID NO: 8468 - protein, 213 aa, Homo sapiens
  Payload ID: 1759;
  Gene Symbol: BCL7B;
  Gene Name: B-cell CLL/lymphoma 7B;
  ENSP ID: ENSP00000411073
MTESRSVTQAGVHWRNLGSLQPLPLRFKQFSCLSLLSSWDYREKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 8469 - protein, 78 aa, Homo sapiens
  Payload ID: 1759;
  Gene Symbol: BCL7B;
  Gene Name: B-cell CLL/lymphoma 7B;
  ENSP ID: ENSP00000414231
MSGRSVRAETRSRAKDDIKKVMAAIEKVRKWEKKWVTVGDTSLRIFKWVPVTDSKERQSLAMLSRLVVNSWPQAVPQP

SEQ ID NO: 8470 - protein, 88 aa, Homo sapiens
  Payload ID: 1759;
  Gene Symbol: BCL7B;
  Gene Name: B-cell CLL/lymphoma 7B;
  ENSP ID: ENSP00000414473
MSGRSVRAETRSRAKDDIKKVMAAIEKVRKWEKKWVTVGDTSLRIFKWVPVTDSKETKTATRVPCLTSISLRWTAAPTQAPAPSRVSP

SEQ ID NO: 8471 - protein, 217 aa, Homo sapiens
  Payload ID: 1760;
  Gene Symbol: BCL7C;
  Gene Name: B-cell CLL/lymphoma 7C;
  Uniprot ID:  Q8WUZ0;
  ENSP ID: ENSP00000215115
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEAPEAYPVFEPVPPVPEAAQGDTEDSEGAPPLKRICPNAPDP

SEQ ID NO: 8472 - protein, 242 aa, Homo sapiens
  Payload ID: 1760;
  Gene Symbol: BCL7C;
  Gene Name: B-cell CLL/lymphoma 7C;
  Uniprot ID:  Q8WUZ0;
  ENSP ID: ENSP00000369674
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEDSGVRMTRRALHEKGLKTEPLRRLLPRRGLRTNVRPSSMAVPDTRAPGGGSKAPRAPRTIPQGKGR

SEQ ID NO: 8473 - protein, 293 aa, Homo sapiens
  Payload ID: 1760;
  Gene Symbol: BCL7C;
  Gene Name: B-cell CLL/lymphoma 7C;
  ENSP ID: ENSP00000459007
  MOD_RES (1)..(1): Any amino acid
XAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAETMEMMLDKKQIQAIFLFELKMGHKAVETLRNINNTLGPGTANEHIVQWWFKKFCKEDKSLEDEKHSVWPSEVDNDQLKALIEADPVKTTQEVAQELNHRPFYGRLAFEANWKGEKAQ

SEQ ID NO: 8474 - protein, 104 aa, Homo sapiens
  Payload ID: 1760;
  Gene Symbol: BCL7C;
  Gene Name: B-cell CLL/lymphoma 7C;
  ENSP ID: ENSP00000461177
MAGRTVRAETRSRAKDDIKKVMATIEKVRRWEKRWVTVGDTSLRIFKWVPVVDPQEEVPCKRAQSPVLGAPPSPAALCHLPDPQKGSLRRLSPHGWAKREIPGA

SEQ ID NO: 8475 - protein, 1426 aa, Homo sapiens
  Payload ID: 1761;
  Gene Symbol: BCL9;
  Gene Name: B-cell CLL/lymphoma 9;
  Uniprot ID:  O00512;
  ENSP ID: ENSP00000234739
MHSSNPKVRSSPSGNTQSSPKSKQEVMVRPPTVMSPSGNPQLDSKFSNQGKQGGSASQSQPSPCDSKSGGHTPKALPGPGGSMGLKNGAGNGAKGKGKRERSISADSFDQRDPGTPNDDSDIKECNSADHIKSQDSQHTPHSMTPSNATAPRSSTPSHGQTTATEPTPAQKTPAKVVYVFSTEMANKAAEAVLKGQVETIVSFHIQNISNNKTERSTAPLNTQISALRNDPKPLPQQPPAPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKQEQVVVQQCSLQDMMVHQHGPRGVVRGPPPPYQMTPSEGWAPGGTEPFSDGINMPHSLPPRGMAPHPNMPGSQMRLPGFAGMINSEMEGPNVPNPASRPGLSGVSWPDDVPKIPDGRNFPPGQGIFSGPGRGERFPNPQGLSEEMFQQQLAEKQLGLPPGMAMEGIRPSMEMNRMIPGSQRHMEPGNNPIFPRIPVEGPLSPSRGDFPKGIPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPIGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGMGINTQNPRISGPNPVVPMPTLSPMGMTQPLSHSNQMPSPNAVGPNIPPHGVPMGPGLMSHNPIMGHGSQEPPMVPQGRMGFPQGFPPVQSPPQQVPFPHNGPSGGQGSFPGGMGFPGEGPLGRPSNLPQSSADAALCKPGGPGGPDSFTVLGNSMPSVFTDPDLQEVIRPGATGIPEFDLSRIIPSEKPSQTLQYFPRGEVPGRKQPQGPGPGFSHMQGMMGEQAPRMGLALPGMGGPGPVGTPDIPLGTAPSMPGHNPMRPPAFLQQGMMGPHHRMMSPAQSTMPGQPTLMSNPAAAVGMIPGKDRGPAGLYTHPGPVGSPGMMMSMQGMMGPQQNIMIPPQMRPRGMAADVGMGGFSQGPGNPGNMMF

SEQ ID NO: 8476 - protein, 1394 aa, Homo sapiens
  Payload ID: 1761;
  Gene Symbol: BCL9;
  Gene Name: B-cell CLL/lymphoma 9;
  ENSP ID: ENSP00000479694
MHSSNPKVRSSPSGNTQSSPKSKQEVMVRPPTVMSPSGNPQLDSKFSNQGKQGGSASQSQPSPCDSKSGGHTPKALPGPGGSMGLKNGAGNGAKGKGKRERSISADSFDQRDPGTPNDDSDIKECNSADHIKSQDSQHTPHSMTPSNATAPRSSTPSHGQTTATEPTPAQKTPAKVVYVFSTEMANKAAEAVLKGQVETIVSFHIQNISNNKTERSTAPLNTQISALRNDPKPLPQQPPAPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKQEQVVVQQCSLQDMMVHQHGPRGVVRGPPPPYQMTPSEGWAPGGTEPFSDGINMPHSLPPRGMAPHPNMPGSQMRLPGFAGMINSEMEGPNVPNPASRPGLSGVSWPDDVPKIPDGRNFPPGQGIFSGPGRGERFPNPQGLSEEMFQQQLAEKQLGLPPGMAMEGIRPSMEMNRMIPGSQRHMEPGNNPIFPRIPVEGPLSPSRGDFPKGIPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPIGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGMGINTQNPRISGPNPVVPMPTLSPMGMTQPLSHSNQMPSPNAVGPNIPPHGVPMGPGLMSHNPIMGHGSQEPPMVPQGRMGFPQGFPPVQSPPQQVPFPHNGPSGGQGSFPGGMGFPGEGPLGRPSNLPQSSADAALCKPGGPGGPDSFTVLGNSMPSVFTDPDLQEVIRPGATGIPEFDLSRIIPSEKPSQTLQYFPRGEVPGRKQPQGPGPGFSHMQGMMGEQAPRMGLALPGMGGPGPVGTPDIPLGTAPSMPGHNPMRPPAFLQQGMMGPHHRMMSPAQSTMPGQPTLMSNPAAAVGMIPGKDRGPAGLYTHPGPVGSPGMMMSMQGMMGPNRTS

SEQ ID NO: 8477 - protein, 1499 aa, Homo sapiens
  Payload ID: 1762;
  Gene Symbol: BCL9L;
  Gene Name: B-cell CLL/lymphoma 9-like;
  Uniprot ID:  Q86UU0;
  ENSP ID: ENSP00000335320
MRILANKTRLPHPRRREAPGSPPLSPRGHCPPAPAKPMHPENKLTNHGKTGNGGAQSQHQNVNQGPTCNVGSKGVGAGNHGAKANQISPSNSSLKNPQAGVPPFSSLKGKVKRDRSVSVDSGEQREAGTPSLDSEAKEVAPRSKRRCVLERKQPYSGDEWCSGPDSEEDDKPIGATHNCNVADPAMAAPQLGPGQTTQLPLSESSVPGAPHGPPPGLRPDAPGGGGGGGGVPGKPPSQFVYVFTTHLANTAAEAVLQGRADSILAYHQQNVPRAKLDQAPKVPPTPEPLPLSTPSAGTPQSQPPPLPPPPPPAPGSAPPALPPEGPPEDSSQDLAPNSVGAASTGGGTGGTHPNTPTATTANNPLPPGGDPSSAPGPALLGEAAAPGNGQRSLVGSEGLSKEQLEHRERSLQTLRDIERLLLRSGETEPFLKGPPGGAGEGGPPAQAPPPPQQPPTAPPSGLKKYEEPLQSMISQTQSLGGPPLEHEVPGHPPGGDMGQQMNMMIQRLGQDSLTPEQVAWRKLQEEYYEEKRRKEEQIGLHGSRPLQDMMGMGGMMVRGPPPPYHSKPGDQWPPGMGAQLRGPMDVQDPMQLRGGPPFPGPRFPGNQIQRVPGFGGMQSMPMEVPMNAMQRPVRPGMGWTEDLPPMGGPSNFAQNTMPYPGGQGEAERFMTPRVREELLRHQLLEKRSMGMQRPLGMAGSGMGQSMEMERMMQAHRQMDPAMFPGQMAGGEGLAGTPMGMEFGGGRGLLSPPMGQSGLREVDPPMGPGNLNMNMNVNMNMNMNLNVQMTPQQQMLMSQKMRGPGDLMGPQGLSPEEMARVRAQNSSGVMGGPQKMLMPSQFPNQGQQGFSGGQGPYQAMSQDMGNTQDMFSPDQSSMPMSNVGTTRLSHMPLPPASNPPGTVHSAPNRGLGRRPSDLTISINQMGSPGMGHLKSPTLSQVHSPLVTSPSANLKSPQTPSQMVPLPSANPPGPLKSPQVLGSSLSVRSPTGSPSRLKSPSMAVPSPGWVASPKTAMPSPGVSQNKQPPLNMNSSTTLSNMEQGTLPPSGPRSSSSAPPANPPSGLMNPSLPFTSSPDPTPSQNPLSLMMTQMSKYAMPSSTPLYHNAIKTIATSDDELLPDRPLLPPPPPPQGSGPGISNSQPSQMHLNSAAAQSPMGMNLPGQQPLSHEPPPAMLPSPTPLGSNIPLHPNAQGTGGPPQNSMMMAPGGPDSLNAPCGPVPSSSQMMPFPPRLQQPHGAMAPTGGGGGGPGLQQHYPSGMALPPEDLPNQPPGPMPPQQHLMGKAMAGRMGDAYPPGVLPGVASVLNDPELSEVIRPTPTGIPEFDLSRIIPSEKPSSTLQYFPKSENQPPKAQPPNLHLMNLQNMMAEQTPSRPPNLPGQQGVQRGLNMSMCHPGQMSLLGRTGVPPQQGMVPHGLHQGVMSPPQGLMTQQNFMLMKQRGVGGEVYSQPPHMLSPQGSLMGPPPQQNLMVSHPLRQRSVSLDSQMGYLPAPGGMANLPF

SEQ ID NO: 8478 - protein, 88 aa, Homo sapiens
  Payload ID: 1762;
  Gene Symbol: BCL9L;
  Gene Name: B-cell CLL/lymphoma 9-like;
  ENSP ID: ENSP00000432804
MRILANKTRLPHPRRREAPGSPPLSPRGHCPPAPAKPMHPENKLTNHGKTGNGGAQSQHQNVNQGPTCNVGSKGVGAGNHGAKANQIS

SEQ ID NO: 8479 - protein, 1462 aa, Homo sapiens
  Payload ID: 1762;
  Gene Symbol: BCL9L;
  Gene Name: B-cell CLL/lymphoma 9-like;
  ENSP ID: ENSP00000482938
MHPENKLTNHGKTGNGGAQSQHQNVNQGPTCNVGSKGVGAGNHGAKANQISPSNSSLKNPQAGVPPFSSLKGKVKRDRSVSVDSGEQREAGTPSLDSEAKEVAPRSKRRCVLERKQPYSGDEWCSGPDSEEDDKPIGATHNCNVADPAMAAPQLGPGQTTQLPLSESSVPGAPHGPPPGLRPDAPGGGGGGGGVPGKPPSQFVYVFTTHLANTAAEAVLQGRADSILAYHQQNVPRAKLDQAPKVPPTPEPLPLSTPSAGTPQSQPPPLPPPPPPAPGSAPPALPPEGPPEDSSQDLAPNSVGAASTGGGTGGTHPNTPTATTANNPLPPGGDPSSAPGPALLGEAAAPGNGQRSLVGSEGLSKEQLEHRERSLQTLRDIERLLLRSGETEPFLKGPPGGAGEGGPPAQAPPPPQQPPTAPPSGLKKYEEPLQSMISQTQSLGGPPLEHEVPGHPPGGDMGQQMNMMIQRLGQDSLTPEQVAWRKLQEEYYEEKRRKEEQIGLHGSRPLQDMMGMGGMMVRGPPPPYHSKPGDQWPPGMGAQLRGPMDVQDPMQLRGGPPFPGPRFPGNQIQRVPGFGGMQSMPMEVPMNAMQRPVRPGMGWTEDLPPMGGPSNFAQNTMPYPGGQGEAERFMTPRVREELLRHQLLEKRSMGMQRPLGMAGSGMGQSMEMERMMQAHRQMDPAMFPGQMAGGEGLAGTPMGMEFGGGRGLLSPPMGQSGLREVDPPMGPGNLNMNMNVNMNMNMNLNVQMTPQQQMLMSQKMRGPGDLMGPQGLSPEEMARVRAQNSSGVMGGPQKMLMPSQFPNQGQQGFSGGQGPYQAMSQDMGNTQDMFSPDQSSMPMSNVGTTRLSHMPLPPASNPPGTVHSAPNRGLGRRPSDLTISINQMGSPGMGHLKSPTLSQVHSPLVTSPSANLKSPQTPSQMVPLPSANPPGPLKSPQVLGSSLSVRSPTGSPSRLKSPSMAVPSPGWVASPKTAMPSPGVSQNKQPPLNMNSSTTLSNMEQGTLPPSGPRSSSSAPPANPPSGLMNPSLPFTSSPDPTPSQNPLSLMMTQMSKYAMPSSTPLYHNAIKTIATSDDELLPDRPLLPPPPPPQGSGPGISNSQPSQMHLNSAAAQSPMGMNLPGQQPLSHEPPPAMLPSPTPLGSNIPLHPNAQGTGGPPQNSMMMAPGGPDSLNAPCGPVPSSSQMMPFPPRLQQPHGAMAPTGGGGGGPGLQQHYPSGMALPPEDLPNQPPGPMPPQQHLMGKAMAGRMGDAYPPGVLPGVASVLNDPELSEVIRPTPTGIPEFDLSRIIPSEKPSSTLQYFPKSENQPPKAQPPNLHLMNLQNMMAEQTPSRPPNLPGQQGVQRGLNMSMCHPGQMSLLGRTGVPPQQGMVPHGLHQGVMSPPQGLMTQQNFMLMKQRGVGGEVYSQPPHMLSPQGSLMGPPPQQNLMVSHPLRQRSVSLDSQMGYLPAPGGMANLPF

SEQ ID NO: 8480 - protein, 456 aa, Homo sapiens
  Payload ID: 1763;
  Gene Symbol: BLNK;
  Gene Name: B-cell linker;
  Uniprot ID:  Q8WV28;
  ENSP ID: ENSP00000224337
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 8481 - protein, 433 aa, Homo sapiens
  Payload ID: 1763;
  Gene Symbol: BLNK;
  Gene Name: B-cell linker;
  Uniprot ID:  Q8WV28;
  ENSP ID: ENSP00000360218
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 8482 - protein, 299 aa, Homo sapiens
  Payload ID: 1763;
  Gene Symbol: BLNK;
  Gene Name: B-cell linker;
  ENSP ID: ENSP00000391924
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 8483 - protein, 404 aa, Homo sapiens
  Payload ID: 1763;
  Gene Symbol: BLNK;
  Gene Name: B-cell linker;
  Uniprot ID:  Q8WV28;
  ENSP ID: ENSP00000397487
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 8484 - protein, 65 aa, Homo sapiens
  Payload ID: 1763;
  Gene Symbol: BLNK;
  Gene Name: B-cell linker;
  ENSP ID: ENSP00000465741
MDKLNKITVPASQKLRQLQKMVHDIKNNEGGIMNKIKKLKVKAPPSVPRRDYASDTCSLSWNPSK

SEQ ID NO: 8485 - protein, 121 aa, Homo sapiens
  Payload ID: 1763;
  Gene Symbol: BLNK;
  Gene Name: B-cell linker;
  ENSP ID: ENSP00000466331
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIG

SEQ ID NO: 8486 - protein, 241 aa, Homo sapiens
  Payload ID: 1764;
  Gene Symbol: BCAP29;
  Gene Name: B-cell receptor-associated prt 29;
  Uniprot ID:  Q9UHQ4;
  ENSP ID: ENSP00000005259
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 8487 - protein, 241 aa, Homo sapiens; identical to SEQ ID NO: 8486
  Payload ID: 1764;
  Gene Symbol: BCAP29;
  Gene Name: B-cell receptor-associated prt 29;
  Uniprot ID:  Q9UHQ4;
  ENSP ID: ENSP00000368412

SEQ ID NO: 8488 - protein, 348 aa, Homo sapiens
  Payload ID: 1764;
  Gene Symbol: BCAP29;
  Gene Name: B-cell receptor-associated prt 29;
  Uniprot ID:  Q9UHQ4;
  ENSP ID: ENSP00000368414
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQHSSFGEFLSKRSHKNGSIGKQTGSRKGSFRKRQQEKTVNFIKDTCNILCQNDNFVMLASRKFKFRKMHYDRFVIFLMPHIGCIVMALSKYLMMFQIYCKVCIPALKKNISMLNTIFTY

SEQ ID NO: 8489 - protein, 171 aa, Homo sapiens
  Payload ID: 1764;
  Gene Symbol: BCAP29;
  Gene Name: B-cell receptor-associated prt 29;
  ENSP ID: ENSP00000390733
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRFLLAKVHCRKL

SEQ ID NO: 8490 - protein, 133 aa, Homo sapiens
  Payload ID: 1764;
  Gene Symbol: BCAP29;
  Gene Name: B-cell receptor-associated prt 29;
  ENSP ID: ENSP00000395828
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSN

SEQ ID NO: 8491 - protein, 348 aa, Homo sapiens; identical to SEQ ID NO: 8488
  Payload ID: 1764;
  Gene Symbol: BCAP29;
  Gene Name: B-cell receptor-associated prt 29;
  Uniprot ID:  Q9UHQ4;
  ENSP ID: ENSP00000400718

SEQ ID NO: 8492 - protein, 230 aa, Homo sapiens
  Payload ID: 1764;
  Gene Symbol: BCAP29;
  Gene Name: B-cell receptor-associated prt 29;
  ENSP ID: ENSP00000409350
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQ

SEQ ID NO: 8493 - protein, 163 aa, Homo sapiens
  Payload ID: 1764;
  Gene Symbol: BCAP29;
  Gene Name: B-cell receptor-associated prt 29;
  ENSP ID: ENSP00000414164
  MOD_RES (1)..(1): Any amino acid
XDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQKSHSQPGAAAFLVKEVESF

SEQ ID NO: 8494 - protein, 196 aa, Homo sapiens
  Payload ID: 1764;
  Gene Symbol: BCAP29;
  Gene Name: B-cell receptor-associated prt 29;
  ENSP ID: ENSP00000418816
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSD

SEQ ID NO: 8495 - protein, 147 aa, Homo sapiens
  Payload ID: 1764;
  Gene Symbol: BCAP29;
  Gene Name: B-cell receptor-associated prt 29;
  ENSP ID: ENSP00000418993
MKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 8496 - protein, 294 aa, Homo sapiens
  Payload ID: 1764;
  Gene Symbol: BCAP29;
  Gene Name: B-cell receptor-associated prt 29;
  ENSP ID: ENSP00000419681
IATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQKQREILPHRRGESTVTTEAEIGVMEPQQRNADSHQKLEEAKNRFFPRASSSRSMALQIPIKLILDFLASRTMGINLLFQAIKFVIICYCCHSKLIQEHAGQICNGLN

SEQ ID NO: 8497 - protein, 64 aa, Homo sapiens
  Payload ID: 1764;
  Gene Symbol: BCAP29;
  Gene Name: B-cell receptor-associated prt 29;
  ENSP ID: ENSP00000420313
MTLQWAAVATFLYAEIGLILIFCLPFIPPQRWQKIFSFNVWGKIATFWNKAFLTIIILLIVLFL

SEQ ID NO: 8498 - protein, 66 aa, Homo sapiens
  Payload ID: 1764;
  Gene Symbol: BCAP29;
  Gene Name: B-cell receptor-associated prt 29;
  ENSP ID: ENSP00000420365
MTLQWAAVATFLYAEIGLILIFCLPFIPPQRWQKIFSFNVWGKIATFWNKAFLTIIILLIVLFLEF

SEQ ID NO: 8499 - protein, 246 aa, Homo sapiens
  Payload ID: 1765;
  Gene Symbol: BCAP31;
  Gene Name: B-cell receptor-associated prt 31;
  Uniprot ID:  P51572;
  ENSP ID: ENSP00000343458
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 8500 - protein, 178 aa, Homo sapiens
  Payload ID: 1765;
  Gene Symbol: BCAP31;
  Gene Name: B-cell receptor-associated prt 31;
  ENSP ID: ENSP00000389740
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLE

SEQ ID NO: 8501 - protein, 313 aa, Homo sapiens
  Payload ID: 1765;
  Gene Symbol: BCAP31;
  Gene Name: B-cell receptor-associated prt 31;
  Uniprot ID:  P51572;
  ENSP ID: ENSP00000392330
MGAEASSSWCPGTALPEERLSVKRASEISGFLGQGSSGEAALDVLTHVLEGAGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 8502 - protein, 182 aa, Homo sapiens
  Payload ID: 1765;
  Gene Symbol: BCAP31;
  Gene Name: B-cell receptor-associated prt 31;
  ENSP ID: ENSP00000394270
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENR

SEQ ID NO: 8503 - protein, 188 aa, Homo sapiens
  Payload ID: 1765;
  Gene Symbol: BCAP31;
  Gene Name: B-cell receptor-associated prt 31;
  ENSP ID: ENSP00000400345
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADL

SEQ ID NO: 8504 - protein, 138 aa, Homo sapiens
  Payload ID: 1765;
  Gene Symbol: BCAP31;
  Gene Name: B-cell receptor-associated prt 31;
  ENSP ID: ENSP00000402342
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKK

SEQ ID NO: 8505 - protein, 187 aa, Homo sapiens
  Payload ID: 1765;
  Gene Symbol: BCAP31;
  Gene Name: B-cell receptor-associated prt 31;
  ENSP ID: ENSP00000409888
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKAD

SEQ ID NO: 8506 - protein, 785 aa, Homo sapiens
  Payload ID: 1766;
  Gene Symbol: BANK1;
  Gene Name: B-cell scaffold prt with ankyrin repeats 1;
  Uniprot ID:  Q8NDB2;
  ENSP ID: ENSP00000320509
MLPAAPGKGLGSPDPAPCGPAPPGNTKDIIMIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFCGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 8507 - protein, 755 aa, Homo sapiens
  Payload ID: 1766;
  Gene Symbol: BANK1;
  Gene Name: B-cell scaffold prt with ankyrin repeats 1;
  Uniprot ID:  Q8NDB2;
  ENSP ID: ENSP00000388817
MIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFCGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 8508 - protein, 652 aa, Homo sapiens
  Payload ID: 1766;
  Gene Symbol: BANK1;
  Gene Name: B-cell scaffold prt with ankyrin repeats 1;
  Uniprot ID:  Q8NDB2;
  ENSP ID: ENSP00000412748
MLPAAPGKGLGSPDPAPCGPAPPDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFCGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 8509 - protein, 770 aa, Homo sapiens
  Payload ID: 1766;
  Gene Symbol: BANK1;
  Gene Name: B-cell scaffold prt with ankyrin repeats 1;
  Uniprot ID:  Q8NDB2;
  ENSP ID: ENSP00000421443
MVNCHLKIGNTKDIIMIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFCGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 8510 - protein, 652 aa, Homo sapiens; identical to SEQ ID NO: 8508
  Payload ID: 1766;
  Gene Symbol: BANK1;
  Gene Name: B-cell scaffold prt with ankyrin repeats 1;
  Uniprot ID:  Q8NDB2;
  ENSP ID: ENSP00000422314

SEQ ID NO: 8511 - protein, 171 aa, Homo sapiens
  Payload ID: 1767;
  Gene Symbol: BTG1;
  Gene Name: B-cell translocation gene 1, anti-proliferative;
  Uniprot ID:  P62324;
  ENSP ID: ENSP00000256015
MHPFYTRAATMIGEIAAAVSFISKFLRTKGLTSERQLQTFSQSLQELLAEHYKHHWFPEKPCKGSGYRCIRINHKMDPLIGQAAQRIGLSSQELFRLLPSELTLWVDPYEVSYRIGEDGSICVLYEASPAGGSTQNSTNVQMVDSRISCKEELLLGRTSPSKNYNMMTVSG

SEQ ID NO: 8512 - protein, 84 aa, Homo sapiens
  Payload ID: 1767;
  Gene Symbol: BTG1;
  Gene Name: B-cell translocation gene 1, anti-proliferative;
  ENSP ID: ENSP00000447551
MDPLIGQAAQRIGLSSQELFRLLPSELTLWVDPYEVSYRIGEDGSICVLYEASPAGGSTQNSTNVQMVDSRISCKEELLLGRTS

SEQ ID NO: 8513 - protein, 223 aa, Homo sapiens
  Payload ID: 1768;
  Gene Symbol: BTG4;
  Gene Name: B-cell translocation gene 4;
  Uniprot ID:  Q9NY30;
  ENSP ID: ENSP00000348300
MRDEIATTVFFVTRLVKKHDKLSKQQIEDFAEKLMTILFETYRSHWHSDCPSKGQAFRCIRINNNQNKDPILERACVESNVDFSHLGLPKEMTIWVDPFEVCCRYGEKNHPFTVASFKGRWEEWELYQQISYAVSRASSDVSSGTSCDEESCSKEPRVIPKVSNPKSIYQVENLKQPFQSWLQIPRKKNVVDGRVGLLGNTYHGSQKHPKCYRPAMHRLDRIL

SEQ ID NO: 8514 - protein, 160 aa, Homo sapiens
  Payload ID: 1768;
  Gene Symbol: BTG4;
  Gene Name: B-cell translocation gene 4;
  ENSP ID: ENSP00000392358
MRDEIATTVFFVTRLVKKHDKLSKQQIEDFAEKLMTILFETYRSHWHSDCPSKGQAFRCIRINNNQNKDPILERACVESNVDFSHLGLPKEMTIWVDPFEVCCRYGEKNHPFTVASFKGRWEEWELYQQISYAVSRASSDVSSGTSCDEESCSKEPRVIP

SEQ ID NO: 8515 - protein, 206 aa, Homo sapiens
  Payload ID: 1768;
  Gene Symbol: BTG4;
  Gene Name: B-cell translocation gene 4;
  Uniprot ID:  Q9NY30;
  ENSP ID: ENSP00000432018
MRDEIATTVFFVTRLVKKHDKLSKQQIEDFAEKLMTILFETYRSHWHSDCPSKGQAFRCIRINNNQNKDPILERACVESNVDFSHLGLPKEMTIWVDPFEVCCRYGEKNHPFTVASFKGRWEEWELYQQISYAVSRASSDVSSGTSCDEESCSKEPRVIPKVSNPKSIYQVKSVPVLFYTFFLSNSKKNALIMKTKKQKNMERTKL

SEQ ID NO: 8516 - protein, 101 aa, Homo sapiens
  Payload ID: 1769;
  Gene Symbol: BBC3;
  Gene Name: BCL2 binding component 3;
  Uniprot ID:  Q96PG8;
  ENSP ID: ENSP00000300880
MKFGMGSAQACPCQVPRAASTTWVPCQICETRGAAAAPPLTLEGPVQSHHGTPALTQGPQSPRDGAQLGACTRPVDVRDSGGRPLPPPDTLASAGDFLCTM

SEQ ID NO: 8517 - protein, 131 aa, Homo sapiens
  Payload ID: 1769;
  Gene Symbol: BBC3;
  Gene Name: BCL2 binding component 3;
  Uniprot ID:  Q9BXH1;
  ENSP ID: ENSP00000341155
MKFGMGSAQACPCQVPRAASTTWVPCQICGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 8518 - protein, 193 aa, Homo sapiens
  Payload ID: 1769;
  Gene Symbol: BBC3;
  Gene Name: BCL2 binding component 3;
  Uniprot ID:  Q9BXH1;
  ENSP ID: ENSP00000395862
MARARQEGSSPEPVEGLARDGPRPFPLGRLVPSAVSCGLCEPGLAAAPAAPTLLPAAYLCAPTAPPAVTAALGGSRWPGGPRSRPRGPRPDGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 8519 - protein, 261 aa, Homo sapiens
  Payload ID: 1769;
  Gene Symbol: BBC3;
  Gene Name: BCL2 binding component 3;
  Uniprot ID:  Q96PG8;
  ENSP ID: ENSP00000404503
MKFGMGSAQACPCQVPRAASTTWVPCQICGPRERHGPRTPGGQLPGARRGPGPRRPAPLPARPPGALGSVLRPLRARPGCRPRRPHPAARCLPLRPHRPTRRHRRPGGFPLAWGSPQPAPRPAPGRSSALALAGGAAPGVARAQRPGGSGGRSHPGGPGSPRGGGTVGPGDRGPAAADGGRPQRTVRAAETRGAAAAPPLTLEGPVQSHHGTPALTQGPQSPRDGAQLGACTRPVDVRDSGGRPLPPPDTLASAGDFLCTM

SEQ ID NO: 8520 - protein, 184 aa, Homo sapiens
  Payload ID: 1770;
  Gene Symbol: BMF;
  Gene Name: Bcl2 modifying factor;
  Uniprot ID:  Q96LC9;
  ENSP ID: ENSP00000346697
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYGNAGYRLPLPASFPAVLPIGEQPPEGQWQHQAEVQIARKLQCIADQFHRLHVQQHQQNQNRVWWQILLFLHNLALNGEENRNGAGPR

SEQ ID NO: 8521 - protein, 184 aa, Homo sapiens; identical to SEQ ID NO: 8520
  Payload ID: 1770;
  Gene Symbol: BMF;
  Gene Name: Bcl2 modifying factor;
  Uniprot ID:  Q96LC9;
  ENSP ID: ENSP00000380703

SEQ ID NO: 8522 - protein, 163 aa, Homo sapiens
  Payload ID: 1770;
  Gene Symbol: BMF;
  Gene Name: Bcl2 modifying factor;
  Uniprot ID:  Q96LC9;
  ENSP ID: ENSP00000396511
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYGNAGYRLPLPASFPAVLPIGEQPPEGQWQHQAEHQQNQNRVWWQILLFLHNLALNGEENRNGAGPR

SEQ ID NO: 8523 - protein, 13 aa, Homo sapiens
  Payload ID: 1770;
  Gene Symbol: BMF;
  Gene Name: Bcl2 modifying factor;
  ENSP ID: ENSP00000452660
MEPSQCVEELEDD

SEQ ID NO: 8524 - protein, 184 aa, Homo sapiens; identical to SEQ ID NO: 8520
  Payload ID: 1770;
  Gene Symbol: BMF;
  Gene Name: Bcl2 modifying factor;
  Uniprot ID:  Q96LC9;
  ENSP ID: ENSP00000453522

SEQ ID NO: 8525 - protein, 184 aa, Homo sapiens; identical to SEQ ID NO: 8520
  Payload ID: 1770;
  Gene Symbol: BMF;
  Gene Name: Bcl2 modifying factor;
  Uniprot ID:  Q96LC9;
  ENSP ID: ENSP00000453892

SEQ ID NO: 8526 - protein, 129 aa, Homo sapiens
  Payload ID: 1770;
  Gene Symbol: BMF;
  Gene Name: Bcl2 modifying factor;
  Uniprot ID:  Q96LC9;
  ENSP ID: ENSP00000453913
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYAPAEPKSCVVADPPLPAQPCFEWRREQERGRP

SEQ ID NO: 8527 - protein, 129 aa, Homo sapiens; identical to SEQ ID NO: 8526
  Payload ID: 1770;
  Gene Symbol: BMF;
  Gene Name: Bcl2 modifying factor;
  Uniprot ID:  Q96LC9;
  ENSP ID: ENSP00000453919

SEQ ID NO: 8528 - protein, 61 aa, Homo sapiens
  Payload ID: 1770;
  Gene Symbol: BMF;
  Gene Name: Bcl2 modifying factor;
  ENSP ID: ENSP00000454142
MEPSQCVEELEDDVFQPEDGEPVTQPGSLLSADLFAQSLLDCPLSRLQLFPLTHCCGPGLR

SEQ ID NO: 8529 - protein, 275 aa, Homo sapiens
  Payload ID: 1771;
  Gene Symbol: BNIPL;
  Gene Name: BCL2/adenovirus E1B 19kD interacting prt like;
  Uniprot ID:  Q7Z465;
  ENSP ID: ENSP00000295294
MRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQLDRDLHGSGGT

SEQ ID NO: 8530 - protein, 341 aa, Homo sapiens
  Payload ID: 1771;
  Gene Symbol: BNIPL;
  Gene Name: BCL2/adenovirus E1B 19kD interacting prt like;
  ENSP ID: ENSP00000355333
  MOD_RES (1)..(1): Any amino acid
XREIAEAPELGAALRHGELELKEEWQDEEFPRLLPEEAGTSEDPEDPKGDSQAGTPSTLALCGQRPMRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQLDRDLHGSGGT

SEQ ID NO: 8531 - protein, 357 aa, Homo sapiens
  Payload ID: 1771;
  Gene Symbol: BNIPL;
  Gene Name: BCL2/adenovirus E1B 19kD interacting prt like;
  Uniprot ID:  Q7Z465;
  ENSP ID: ENSP00000357927
MGTIQEAGKKTDVGVREIAEAPELGAALRHGELELKEEWQDEEFPRLLPEEAGTSEDPEDPKGDSQAAAGTPSTLALCGQRPMRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQLDRDLHGSGGT

SEQ ID NO: 8532 - protein, 100 aa, Homo sapiens
  Payload ID: 1771;
  Gene Symbol: BNIPL;
  Gene Name: BCL2/adenovirus E1B 19kD interacting prt like;
  ENSP ID: ENSP00000376550
MRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFR

SEQ ID NO: 8533 - protein, 204 aa, Homo sapiens
  Payload ID: 1771;
  Gene Symbol: BNIPL;
  Gene Name: BCL2/adenovirus E1B 19kD interacting prt like;
  Uniprot ID:  Q7Z465;
  ENSP ID: ENSP00000435072
MRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRVL

SEQ ID NO: 8534 - protein, 271 aa, Homo sapiens
  Payload ID: 1772;
  Gene Symbol: BNIP1;
  Gene Name: BCL2/adenovirus E1B 19kDa interacting prt 1;
  Uniprot ID:  Q12981;
  ENSP ID: ENSP00000231668
MAAPQDVHVRICNQEIVKFDLEVKALIQDIRDCSGPLSALTELNTKVKEKFQQLRHRIQPVLYQRAFIWTASTFFFKLTYSLTDFSSTQHDFNSPTTPVTFSDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 8535 - protein, 237 aa, Homo sapiens
  Payload ID: 1772;
  Gene Symbol: BNIP1;
  Gene Name: BCL2/adenovirus E1B 19kDa interacting prt 1;
  Uniprot ID:  Q12981;
  ENSP ID: ENSP00000239214
MAAPQDVHVRICNQEIVKFDLEVKALIQDIRDCSGPLSALTELNTKVKEKFQQLRHRIQPVLYQRAFIWTASTFFFKLTYSLTDFSSTQHDFNSPTTPVTFSDLEQLAKEQDKESEKQLLLQEVENHKKQMLRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 8536 - protein, 228 aa, Homo sapiens
  Payload ID: 1772;
  Gene Symbol: BNIP1;
  Gene Name: BCL2/adenovirus E1B 19kDa interacting prt 1;
  Uniprot ID:  Q12981;
  ENSP ID: ENSP00000239215
MAAPQDVHVRICNQEIVKFDLEVKALIQDIRDCSGPLSALTELNTKVKEKFQQLRHRIQDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 8537 - protein, 194 aa, Homo sapiens
  Payload ID: 1772;
  Gene Symbol: BNIP1;
  Gene Name: BCL2/adenovirus E1B 19kDa interacting prt 1;
  Uniprot ID:  Q12981;
  ENSP ID: ENSP00000377365
MAAPQDVHVRICNQEIVKFDLEVKALIQDIRDCSGPLSALTELNTKVKEKFQQLRHRIQDLEQLAKEQDKESEKQLLLQEVENHKKQMLRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 8538 - protein, 40 aa, Homo sapiens
  Payload ID: 1772;
  Gene Symbol: BNIP1;
  Gene Name: BCL2/adenovirus E1B 19kDa interacting prt 1;
  ENSP ID: ENSP00000429717
TESLMGISRMMAQQVQQSEEAMQSLVPFKRCESEATGETA

SEQ ID NO: 8539 - protein, 435 aa, Homo sapiens
  Payload ID: 1773;
  Gene Symbol: BNIP2;
  Gene Name: BCL2/adenovirus E1B 19kDa interacting prt 2;
  ENSP ID: ENSP00000267859
MLCGFQEDATPPPPPRPRRLHRRLPRPEEVGMLSLPPGLLTVSGSAAAADAVPLRPGDWAGVSTADRGERAPLGPAFCDLAVSPTSPAWRGEEDEGAKASSGDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 8540 - protein, 204 aa, Homo sapiens
  Payload ID: 1773;
  Gene Symbol: BNIP2;
  Gene Name: BCL2/adenovirus E1B 19kDa interacting prt 2;
  ENSP ID: ENSP00000393644
EKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQYEEEKFKKKQKRVDQELNGKQDEPKNEQ

SEQ ID NO: 8541 - protein, 87 aa, Homo sapiens
  Payload ID: 1773;
  Gene Symbol: BNIP2;
  Gene Name: BCL2/adenovirus E1B 19kDa interacting prt 2;
  ENSP ID: ENSP00000398364
  MOD_RES (1)..(1): Any amino acid
XDDSIEADILAITGPEDQPGSLEVNGNKVRKKLMAPDISLTLDPSDGSVLSDDLDESGEIDLDGLDTPSENSNEFEWEVISWKDIFR

SEQ ID NO: 8542 - protein, 376 aa, Homo sapiens
  Payload ID: 1773;
  Gene Symbol: BNIP2;
  Gene Name: BCL2/adenovirus E1B 19kDa interacting prt 2;
  Uniprot ID:  Q12982;
  ENSP ID: ENSP00000412767
MEPCPSSAPPPFYPGVGEVAGLRWFSIYDQRPSWYRTKKLGLLDIGSLDYQEFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 8543 - protein, 314 aa, Homo sapiens
  Payload ID: 1773;
  Gene Symbol: BNIP2;
  Gene Name: BCL2/adenovirus E1B 19kDa interacting prt 2;
  Uniprot ID:  Q12982;
  ENSP ID: ENSP00000475320
MEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 8544 - protein, 435 aa, Homo sapiens; identical to SEQ ID NO: 8539
  Payload ID: 1773;
  Gene Symbol: BNIP2;
  Gene Name: BCL2/adenovirus E1B 19kDa interacting prt 2;
  ENSP ID: ENSP00000479818

SEQ ID NO: 8545 - protein, 259 aa, Homo sapiens
  Payload ID: 1774;
  Gene Symbol: BNIP3;
  Gene Name: BCL2/adenovirus E1B 19kDa interacting prt 3;
  Uniprot ID:  Q12983;
  ENSP ID: ENSP00000357625
MGDAAADPPGPALPCEFLRPGCGAPLSPGAQLGRGAPTSAFPPPAAEAHPAARRGLRSPQLPSGAMSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 8546 - protein, 219 aa, Homo sapiens
  Payload ID: 1774;
  Gene Symbol: BNIP3;
  Gene Name: BCL2/adenovirus E1B 19kDa interacting prt 3;
  ENSP ID: ENSP00000446145
SPGAQLGRGAPTSAFPPPAAEAHPAARRGLRSPQLPSGAMSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLG

SEQ ID NO: 8547 - protein, 243 aa, Homo sapiens
  Payload ID: 1774;
  Gene Symbol: BNIP3;
  Gene Name: BCL2/adenovirus E1B 19kDa interacting prt 3;
  ENSP ID: ENSP00000487769
  MOD_RES (1)..(1): Any amino acid
XLPCEFLRPGCGAPLSPGAQLGRGAPTSAFPPPAAEAHPAARRGLRSPQLPSGAMSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGDGASPRCPG

SEQ ID NO: 8548 - protein, 219 aa, Homo sapiens
  Payload ID: 1775;
  Gene Symbol: BNIP3L;
  Gene Name: BCL2/adenovirus E1B 19kDa interacting prt 3-like;
  Uniprot ID:  O60238;
  ENSP ID: ENSP00000370003
MSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 8549 - protein, 179 aa, Homo sapiens
  Payload ID: 1775;
  Gene Symbol: BNIP3L;
  Gene Name: BCL2/adenovirus E1B 19kDa interacting prt 3-like;
  Uniprot ID:  O60238;
  ENSP ID: ENSP00000428597
MNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 8550 - protein, 60 aa, Homo sapiens
  Payload ID: 1775;
  Gene Symbol: BNIP3L;
  Gene Name: BCL2/adenovirus E1B 19kDa interacting prt 3-like;
  ENSP ID: ENSP00000428919
MSSHLVEPPPPLHNNNNNCEENEQSLPPPAGLNIRRRSCRRREGSRGFEEKCGLGIRLVQ

SEQ ID NO: 8551 - protein, 185 aa, Homo sapiens
  Payload ID: 1775;
  Gene Symbol: BNIP3L;
  Gene Name: BCL2/adenovirus E1B 19kDa interacting prt 3-like;
  ENSP ID: ENSP00000429171
EQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGCGN

SEQ ID NO: 8552 - protein, 179 aa, Homo sapiens; identical to SEQ ID NO: 8549
  Payload ID: 1775;
  Gene Symbol: BNIP3L;
  Gene Name: BCL2/adenovirus E1B 19kDa interacting prt 3-like;
  Uniprot ID:  O60238;
  ENSP ID: ENSP00000429698

SEQ ID NO: 8553 - protein, 179 aa, Homo sapiens; identical to SEQ ID NO: 8549
  Payload ID: 1775;
  Gene Symbol: BNIP3L;
  Gene Name: BCL2/adenovirus E1B 19kDa interacting prt 3-like;
  Uniprot ID:  O60238;
  ENSP ID: ENSP00000429851

SEQ ID NO: 8554 - protein, 229 aa, Homo sapiens
  Payload ID: 1775;
  Gene Symbol: BNIP3L;
  Gene Name: BCL2/adenovirus E1B 19kDa interacting prt 3-like;
  ENSP ID: ENSP00000479522
MSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPCQHLLRERKSPWKCV

SEQ ID NO: 8555 - protein, 191 aa, Homo sapiens
  Payload ID: 1776;
  Gene Symbol: BAK1;
  Gene Name: BCL2-antagonist/killer 1;
  ENSP ID: ENSP00000353878
MASGQGPGPPRQECGEPALPSASEEQVAQDTEEVFRSYVFYRHQQQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 8556 - protein, 211 aa, Homo sapiens
  Payload ID: 1776;
  Gene Symbol: BAK1;
  Gene Name: BCL2-antagonist/killer 1;
  Uniprot ID:  Q16611;
  ENSP ID: ENSP00000363591
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 8557 - protein, 153 aa, Homo sapiens
  Payload ID: 1776;
  Gene Symbol: BAK1;
  Gene Name: BCL2-antagonist/killer 1;
  Uniprot ID:  Q16611;
  ENSP ID: ENSP00000391258
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATRPAATPTACLRVASIGAVWWLFWASATVWPYTSTSMA

SEQ ID NO: 8558 - protein, 168 aa, Homo sapiens
  Payload ID: 1777;
  Gene Symbol: BAD;
  Gene Name: BCL2-associated agonist of cell death;
  Uniprot ID:  Q92934;
  ENSP ID: ENSP00000309103
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 8559 - protein, 163 aa, Homo sapiens
  Payload ID: 1777;
  Gene Symbol: BAD;
  Gene Name: BCL2-associated agonist of cell death;
  ENSP ID: ENSP00000378039
MFQIPEFEPSEQEDSSSAERGLGPSPAGDGPSGSGKHHRQAPGLLWDASHQQEQPTSSSHHGGRTSYSPSWESEDSENPSAGMLAEASAGMSAPAADSEAQHAENVKLEALGLWRSGVATAPTPRGRRTTKGWGRSPAPFGAARARRPPTSGQHSAMAASSGG

SEQ ID NO: 8560 - protein, 168 aa, Homo sapiens; identical to SEQ ID NO: 8558
  Payload ID: 1777;
  Gene Symbol: BAD;
  Gene Name: BCL2-associated agonist of cell death;
  Uniprot ID:  Q92934;
  ENSP ID: ENSP00000378040

SEQ ID NO: 8561 - protein, 64 aa, Homo sapiens
  Payload ID: 1777;
  Gene Symbol: BAD;
  Gene Name: BCL2-associated agonist of cell death;
  ENSP ID: ENSP00000438975
MGEEPSPFRGRSRSAPPNLWAAQRYGRELRRMSDEFVDSFKKGLPRPKSAGTATQMRQSSSWTR

SEQ ID NO: 8562 - protein, 51 aa, Homo sapiens
  Payload ID: 1777;
  Gene Symbol: BAD;
  Gene Name: BCL2-associated agonist of cell death;
  ENSP ID: ENSP00000439202
MGEEPSPFRGRSRSAPPNLWAAQRYGRELRRMSDEFVDSFKKGLPRPKSAG

SEQ ID NO: 8563 - protein, 157 aa, Homo sapiens
  Payload ID: 1777;
  Gene Symbol: BAD;
  Gene Name: BCL2-associated agonist of cell death;
  ENSP ID: ENSP00000440575
MFQIPEFEPSEQEDSSSAERGLGPSPAGDGPSGSGKHHRQAPGLLWDASHQQEQPTSSSHHGEGTSSPEERGHSNADAAKLQLDASLPVLVGSELGQGKLRPLPVTFAPHPETPPVPTALGSHLEYGRKYFPQAYAKRGSVLSPLEGGLTQIPFRCV

SEQ ID NO: 8564 - protein, 230 aa, Homo sapiens
  Payload ID: 1778;
  Gene Symbol: BAG1;
  Gene Name: BCL2-associated athanogene;
  Uniprot ID:  Q99933;
  ENSP ID: ENSP00000369026
MNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQGFLPKDLQAEALCKLDRRVKATIEQFMKILEEIDTLILPENFKDSRLKRKGLVKKVQAFLAECDTVEQNICQETERLQSTNFALAE

SEQ ID NO: 8565 - protein, 160 aa, Homo sapiens
  Payload ID: 1778;
  Gene Symbol: BAG1;
  Gene Name: BCL2-associated athanogene;
  ENSP ID: ENSP00000369029
MNRSQEVTRDEESTRSEEVTREEMAAAGLTVTVTHSNEKHDLHVTSQQGSSEPVVQDLAQVVEEVIGVPQSFQKLIFKVLQQIFIEDLLGIGHSQTPGQVSDLKSYDDGRNLTIFDEAHGQSSLARKISEGNGNTVVSTWNTRWLPGHVNWEKEQSTGRG

SEQ ID NO: 8566 - protein, 48 aa, Homo sapiens
  Payload ID: 1778;
  Gene Symbol: BAG1;
  Gene Name: BCL2-associated athanogene;
  ENSP ID: ENSP00000417576
MNRSQEVTRDEESTRSEEAMRSTTFMLPPSRAAVNQLSKTWPRLLKRS

SEQ ID NO: 8567 - protein, 150 aa, Homo sapiens
  Payload ID: 1778;
  Gene Symbol: BAG1;
  Gene Name: BCL2-associated athanogene;
  ENSP ID: ENSP00000419092
MNRSQEVTRDEESTRSEEVTREEMAAAGLTVTVTHSECRAPGNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQ

SEQ ID NO: 8568 - protein, 345 aa, Homo sapiens
  Payload ID: 1778;
  Gene Symbol: BAG1;
  Gene Name: BCL2-associated athanogene;
  ENSP ID: ENSP00000420514
LAQRGGARRPRGDRERLGSRLRALRPGREPRQSEPPAQRGPPPSGRPPARSTASGHDRPTRGAAAGARRPRMKKKTRRRSTRSEELTRSEELTLSEEATWSEEATQSEEATQGEEMNRSQEVTRDEESTRSEEVTREEMAAAGLTVTVTHSNEKHDLHVTSQQGSSEPVVQDLAQVVEEVIGVPQSFQKLIFKGKSLKEMETPLSALGIQDGCRVMLIGKKNSPQEEVELKKLKHLEKSVEKIADQLEELNKELTGIQQGFLPKDLQAEALCKLDRRVKATIEQFMKILEEIDTLILPENFKDSRLKRKGLVKKVQAFLAECDTVEQNICQETERLQSTNFALAE

SEQ ID NO: 8569 - protein, 94 aa, Homo sapiens
  Payload ID: 1778;
  Gene Symbol: BAG1;
  Gene Name: BCL2-associated athanogene;
  ENSP ID: ENSP00000488937
MNRSQEVTRDEESTRSEEVTREEMAAAGLTVTVTHSECRAPGNEKHDLHVTSQQGSSEPVVQDLAQVVEEVIGVPQSFQKLIFKVLQQIFIEDL

SEQ ID NO: 8570 - protein, 345 aa, Homo sapiens; identical to SEQ ID NO: 8568
  Payload ID: 1778;
  Gene Symbol: BAG1;
  Gene Name: BCL2-associated athanogene;
  ENSP ID: ENSP00000489189

SEQ ID NO: 8571 - protein, 63 aa, Homo sapiens
  Payload ID: 1778;
  Gene Symbol: BAG1;
  Gene Name: BCL2-associated athanogene;
  ENSP ID: ENSP00000489401
DGCRVMLIGKKNSPQEEVELKKLKHLEKSVEKIADQLEELNKELTGIQQRWGFTMLARLVSNS

SEQ ID NO: 8572 - protein, 211 aa, Homo sapiens
  Payload ID: 1779;
  Gene Symbol: BAG2;
  Gene Name: BCL2-associated athanogene 2;
  Uniprot ID:  O95816;
  ENSP ID: ENSP00000359727
MAQAKINAKANEGRFCRSSSMADRSSRLLESLDQLELRVEALREAATAVEQEKEILLEMIHSIQNSQDMRQISDGEREELNLTANRLMGRTLTVEVSVETIRNPQQQESLKHATRIIDEVVNKFLDDLGNAKSHLMSLYSACSSEVPHGPVDQKFQSIVIGCALEDQKKIKRRLETLLRNIENSDKAIKLLEHSKGAGSKTLQQNAESRFN

SEQ ID NO: 8573 - protein, 575 aa, Homo sapiens
  Payload ID: 1780;
  Gene Symbol: BAG3;
  Gene Name: BCL2-associated athanogene 3;
  Uniprot ID:  O95817;
  ENSP ID: ENSP00000358081
MSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 8574 - protein, 325 aa, Homo sapiens
  Payload ID: 1780;
  Gene Symbol: BAG3;
  Gene Name: BCL2-associated athanogene 3;
  ENSP ID: ENSP00000410036
MQETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQPMTHRETAPVSQPENKPESKPGPVGPELPPGHIPIQVIRKEVDSKPVSQKPPPPSEKVEVKVPPAPVPCPPPSPGPSAVP

SEQ ID NO: 8575 - protein, 457 aa, Homo sapiens
  Payload ID: 1781;
  Gene Symbol: BAG4;
  Gene Name: BCL2-associated athanogene 4;
  Uniprot ID:  O95429;
  ENSP ID: ENSP00000287322
MSALRRSGYGPSDGPSYGRYYGPGGGDVPVHPPPPLYPLRPEPPQPPISWRVRGGGPAETTWLGEGGGGDGYYPSGGAWPEPGRAGGSHQEQPPYPSYNSNYWNSTARSRAPYPSTYPVRPELQGQSLNSYTNGAYGPTYPPGPGANTASYSGAYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKDSSYPYSQSDQSMNRHNFPCSVHQYESSGTVNNDDSDLLDSQVQYSAEPQLYGNATSDHPNNQDQSSSLPEECVPSDESTPPSIKKIIHVLEKVQYLEQEVEEFVGKKTDKAYWLLEEMLTKELLELDSVETGGQDSVRQARKEAVCKIQAILEKLEKKGL

SEQ ID NO: 8576 - protein, 421 aa, Homo sapiens
  Payload ID: 1781;
  Gene Symbol: BAG4;
  Gene Name: BCL2-associated athanogene 4;
  Uniprot ID:  O95429;
  ENSP ID: ENSP00000393298
MSALRRSGYGPSDGPSYGRYYGPGGGDVPVHPPPPLYPLRPEPPQPPISWRVRGGGPAETTWLGEGGGGDGYYPSGGAWPEPGRAGGSHQSLNSYTNGAYGPTYPPGPGANTASYSGAYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKDSSYPYSQSDQSMNRHNFPCSVHQYESSGTVNNDDSDLLDSQVQYSAEPQLYGNATSDHPNNQDQSSSLPEECVPSDESTPPSIKKIIHVLEKVQYLEQEVEEFVGKKTDKAYWLLEEMLTKELLELDSVETGGQDSVRQARKEAVCKIQAILEKLEKKGL

SEQ ID NO: 8577 - protein, 155 aa, Homo sapiens
  Payload ID: 1781;
  Gene Symbol: BAG4;
  Gene Name: BCL2-associated athanogene 4;
  ENSP ID: ENSP00000430250
AYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKVGDLNVVPLMCV

SEQ ID NO: 8578 - protein, 447 aa, Homo sapiens
  Payload ID: 1782;
  Gene Symbol: BAG5;
  Gene Name: BCL2-associated athanogene 5;
  Uniprot ID:  Q9UL15;
  ENSP ID: ENSP00000299204
MDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 8579 - protein, 488 aa, Homo sapiens
  Payload ID: 1782;
  Gene Symbol: BAG5;
  Gene Name: BCL2-associated athanogene 5;
  Uniprot ID:  Q9UL15;
  ENSP ID: ENSP00000338814
MRFHWLPTLSEPFDRNQELETCIRPLWTPSGSACETEHNKSMDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNETCRHLSCVLSGLIADLDALDVCGRTEIRNYRREVVEDINKLLKYLDLEEEADTTKAFDLRQNHSILKIEKVLKRMREIKNELLQAQNPSELYLSSKTELQGLIGQLDEVSLEKNPCIREARRRAVIEVQTLITYIDLKEALEKRKLFACEEHPSHKAVWNVLGNLSEIQGEVLSFDGNRTDKNYIRLEELLTKQLLALDAVDPQGEEKCKAARKQAVRLAQNILSYLDLKSDEWEY

SEQ ID NO: 8580 - protein, 447 aa, Homo sapiens; identical to SEQ ID NO: 8578
  Payload ID: 1782;
  Gene Symbol: BAG5;
  Gene Name: BCL2-associated athanogene 5;
  Uniprot ID:  Q9UL15;
  ENSP ID: ENSP00000391713

SEQ ID NO: 8581 - protein, 211 aa, Homo sapiens
  Payload ID: 1782;
  Gene Symbol: BAG5;
  Gene Name: BCL2-associated athanogene 5;
  ENSP ID: ENSP00000450497
MDMGNQHPSISRLQEIQKEVKSVEQQVIGFSGLSDDKNYKKLERILTKQLFEIDSVDTEGKGDIQQARKRAAQETERLLKELEQNANHPHRIEIQNIFEEAQSLVREKIVPFYNGGNCVTDEFEEGIQDIILRLTHVKTGGKISLRKARYHTLTKICAVQEIIEDCMKKQPSLPLSEDAHPSVAKINFVMCEVNKARGVLIALLMGVNNNE

SEQ ID NO: 8582 - protein, 1126 aa, Homo sapiens
  Payload ID: 1783;
  Gene Symbol: BAG6;
  Gene Name: BCL2-associated athanogene 6;
  Uniprot ID:  P46379;
  ENSP ID: ENSP00000211379
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 8583 - protein, 1132 aa, Homo sapiens
  Payload ID: 1783;
  Gene Symbol: BAG6;
  Gene Name: BCL2-associated athanogene 6;
  Uniprot ID:  P46379;
  ENSP ID: ENSP00000354368
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 8584 - protein, 1077 aa, Homo sapiens
  Payload ID: 1783;
  Gene Symbol: BAG6;
  Gene Name: BCL2-associated athanogene 6;
  Uniprot ID:  P46379;
  ENSP ID: ENSP00000354875
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 8585 - protein, 1132 aa, Homo sapiens; identical to SEQ ID NO: 8583
  Payload ID: 1783;
  Gene Symbol: BAG6;
  Gene Name: BCL2-associated athanogene 6;
  Uniprot ID:  P46379;
  ENSP ID: ENSP00000365131

SEQ ID NO: 8586 - protein, 1126 aa, Homo sapiens; identical to SEQ ID NO: 8582
  Payload ID: 1783;
  Gene Symbol: BAG6;
  Gene Name: BCL2-associated athanogene 6;
  Uniprot ID:  P46379;
  ENSP ID: ENSP00000365143

SEQ ID NO: 8587 - protein, 1126 aa, Homo sapiens; identical to SEQ ID NO: 8582
  Payload ID: 1783;
  Gene Symbol: BAG6;
  Gene Name: BCL2-associated athanogene 6;
  Uniprot ID:  P46379;
  ENSP ID: ENSP00000372938

SEQ ID NO: 8588 - protein, 1126 aa, Homo sapiens; identical to SEQ ID NO: 8582
  Payload ID: 1783;
  Gene Symbol: BAG6;
  Gene Name: BCL2-associated athanogene 6;
  Uniprot ID:  P46379;
  ENSP ID: ENSP00000372940

SEQ ID NO: 8589 - protein, 259 aa, Homo sapiens
  Payload ID: 1783;
  Gene Symbol: BAG6;
  Gene Name: BCL2-associated athanogene 6;
  ENSP ID: ENSP00000387588
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPET

SEQ ID NO: 8590 - protein, 259 aa, Homo sapiens; identical to SEQ ID NO: 8589
  Payload ID: 1783;
  Gene Symbol: BAG6;
  Gene Name: BCL2-associated athanogene 6;
  ENSP ID: ENSP00000388143

SEQ ID NO: 8591 - protein, 259 aa, Homo sapiens; identical to SEQ ID NO: 8589
  Payload ID: 1783;
  Gene Symbol: BAG6;
  Gene Name: BCL2-associated athanogene 6;
  ENSP ID: ENSP00000388244

SEQ ID NO: 8592 - protein, 197 aa, Homo sapiens
  Payload ID: 1783;
  Gene Symbol: BAG6;
  Gene Name: BCL2-associated athanogene 6;
  ENSP ID: ENSP00000388388
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPP

SEQ ID NO: 8593 - protein, 238 aa, Homo sapiens
  Payload ID: 1783;
  Gene Symbol: BAG6;
  Gene Name: BCL2-associated athanogene 6;
  ENSP ID: ENSP00000388541
SSAEGAPPPGPAPPPATSHPRVIRISHQSVEPVVMMHMNIQGPLSLSPCPDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFL

SEQ ID NO: 8594 - protein, 742 aa, Homo sapiens
  Payload ID: 1783;
  Gene Symbol: BAG6;
  Gene Name: BCL2-associated athanogene 6;
  ENSP ID: ENSP00000388770
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSL

SEQ ID NO: 8595 - protein, 1126 aa, Homo sapiens; identical to SEQ ID NO: 8582
  Payload ID: 1783;
  Gene Symbol: BAG6;
  Gene Name: BCL2-associated athanogene 6;
  Uniprot ID:  P46379;
  ENSP ID: ENSP00000389121

SEQ ID NO: 8596 - protein, 258 aa, Homo sapiens
  Payload ID: 1783;
  Gene Symbol: BAG6;
  Gene Name: BCL2-associated athanogene 6;
  ENSP ID: ENSP00000389355
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPE

SEQ ID NO: 8597 - protein, 206 aa, Homo sapiens
  Payload ID: 1783;
  Gene Symbol: BAG6;
  Gene Name: BCL2-associated athanogene 6;
  ENSP ID: ENSP00000389444
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSEPRVRLVMAQHMIRDIQTLLSRMECRGGPQPQHSQPPPQPPAVTPEPVALSSQTSEPVESEAPP

SEQ ID NO: 8598 - protein, 158 aa, Homo sapiens
  Payload ID: 1783;
  Gene Symbol: BAG6;
  Gene Name: BCL2-associated athanogene 6;
  ENSP ID: ENSP00000389954
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPI

SEQ ID NO: 8599 - protein, 742 aa, Homo sapiens
  Payload ID: 1783;
  Gene Symbol: BAG6;
  Gene Name: BCL2-associated athanogene 6;
  ENSP ID: ENSP00000390185
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVASAAAGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFLQATQTAPPPPPPPPPPPPAPEQQTMPPPGSPSGGAGSPGGLGLESLSPEFFTSVVQGVLSSL

SEQ ID NO: 8600 - protein, 258 aa, Homo sapiens; identical to SEQ ID NO: 8596
  Payload ID: 1783;
  Gene Symbol: BAG6;
  Gene Name: BCL2-associated athanogene 6;
  ENSP ID: ENSP00000390226

SEQ ID NO: 8601 - protein, 1132 aa, Homo sapiens; identical to SEQ ID NO: 8583
  Payload ID: 1783;
  Gene Symbol: BAG6;
  Gene Name: BCL2-associated athanogene 6;
  Uniprot ID:  P46379;
  ENSP ID: ENSP00000390966

SEQ ID NO: 8602 - protein, 158 aa, Homo sapiens; identical to SEQ ID NO: 8598
  Payload ID: 1783;
  Gene Symbol: BAG6;
  Gene Name: BCL2-associated athanogene 6;
  ENSP ID: ENSP00000391323

SEQ ID NO: 8603 - protein, 232 aa, Homo sapiens
  Payload ID: 1783;
  Gene Symbol: BAG6;
  Gene Name: BCL2-associated athanogene 6;
  ENSP ID: ENSP00000391355
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPRE

SEQ ID NO: 8604 - protein, 185 aa, Homo sapiens
  Payload ID: 1783;
  Gene Symbol: BAG6;
  Gene Name: BCL2-associated athanogene 6;
  ENSP ID: ENSP00000391425
  MOD_RES (1)..(1): Any amino acid
XLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQGQQVPGFPTAPTRVVIARPTPPQARPSHPGGPPVSGTLQGAGLGTNASLAQMVSGLVGQLLMQPVLVA

SEQ ID NO: 8605 - protein, 243 aa, Homo sapiens
  Payload ID: 1783;
  Gene Symbol: BAG6;
  Gene Name: BCL2-associated athanogene 6;
  ENSP ID: ENSP00000391613
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNA

SEQ ID NO: 8606 - protein, 226 aa, Homo sapiens
  Payload ID: 1783;
  Gene Symbol: BAG6;
  Gene Name: BCL2-associated athanogene 6;
  ENSP ID: ENSP00000391628
  MOD_RES (1)..(1): Any amino acid
XSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 8607 - protein, 197 aa, Homo sapiens; identical to SEQ ID NO: 8592
  Payload ID: 1783;
  Gene Symbol: BAG6;
  Gene Name: BCL2-associated athanogene 6;
  ENSP ID: ENSP00000391693

SEQ ID NO: 8608 - protein, 215 aa, Homo sapiens
  Payload ID: 1783;
  Gene Symbol: BAG6;
  Gene Name: BCL2-associated athanogene 6;
  ENSP ID: ENSP00000391783
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSEPRVRLVMAQHMIRDIQTLLSRMECRGGPQPQHSQPPPQPPAVTPEPVALSSQTSEPVESEAPPREPMEAEEV

SEQ ID NO: 8609 - protein, 136 aa, Homo sapiens
  Payload ID: 1783;
  Gene Symbol: BAG6;
  Gene Name: BCL2-associated athanogene 6;
  ENSP ID: ENSP00000391947
  MOD_RES (1)..(1): Any amino acid
XRMSRGVNPSLVSWLTTMMGLRLQVVLEHMPVGPDAILRYVRRVGDPPQPLPEEPMEVQGAERASPEPQEWVPIIQQDIQSQRKVKPQPPLSDAYLSGMPAKRRKLRSDIQKRLQEDPNYSPQRFPNAQRAFADDP

SEQ ID NO: 8610 - protein, 215 aa, Homo sapiens; identical to SEQ ID NO: 8608
  Payload ID: 1783;
  Gene Symbol: BAG6;
  Gene Name: BCL2-associated athanogene 6;
  ENSP ID: ENSP00000392110

SEQ ID NO: 8611 - protein, 232 aa, Homo sapiens; identical to SEQ ID NO: 8603
  Payload ID: 1783;
  Gene Symbol: BAG6;
  Gene Name: BCL2-associated athanogene 6;
  ENSP ID: ENSP00000392468

SEQ ID NO: 8612 - protein, 238 aa, Homo sapiens
  Payload ID: 1783;
  Gene Symbol: BAG6;
  Gene Name: BCL2-associated athanogene 6;
  ENSP ID: ENSP00000392563
SSAEGAPPPGPAPPPATSHPRVIRISHQSVEPVVMMHMNIQGPLSLSPCPDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMPGVPAFLQGMTDFL

SEQ ID NO: 8613 - protein, 136 aa, Homo sapiens; identical to SEQ ID NO: 8609
  Payload ID: 1783;
  Gene Symbol: BAG6;
  Gene Name: BCL2-associated athanogene 6;
  ENSP ID: ENSP00000392630
  MOD_RES (1)..(1): Any amino acid

SEQ ID NO: 8614 - protein, 244 aa, Homo sapiens
  Payload ID: 1783;
  Gene Symbol: BAG6;
  Gene Name: BCL2-associated athanogene 6;
  ENSP ID: ENSP00000393280
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAP

SEQ ID NO: 8615 - protein, 262 aa, Homo sapiens
  Payload ID: 1783;
  Gene Symbol: BAG6;
  Gene Name: BCL2-associated athanogene 6;
  ENSP ID: ENSP00000393367
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAP

SEQ ID NO: 8616 - protein, 259 aa, Homo sapiens; identical to SEQ ID NO: 8589
  Payload ID: 1783;
  Gene Symbol: BAG6;
  Gene Name: BCL2-associated athanogene 6;
  ENSP ID: ENSP00000393729

SEQ ID NO: 8617 - protein, 243 aa, Homo sapiens; identical to SEQ ID NO: 8605
  Payload ID: 1783;
  Gene Symbol: BAG6;
  Gene Name: BCL2-associated athanogene 6;
  ENSP ID: ENSP00000393877

SEQ ID NO: 8618 - protein, 259 aa, Homo sapiens; identical to SEQ ID NO: 8589
  Payload ID: 1783;
  Gene Symbol: BAG6;
  Gene Name: BCL2-associated athanogene 6;
  ENSP ID: ENSP00000394111

SEQ ID NO: 8619 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000394240

SEQ ID NO: 8620 - protein, 243 aa, Homo sapiens; identical to SEQ ID NO: 8605
  Payload ID: 1783;
  Gene Symbol: BAG6;
  Gene Name: BCL2-associated athanogene 6;
  ENSP ID: ENSP00000394342

SEQ ID NO: 8621 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000394608

SEQ ID NO: 8622 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000394714

SEQ ID NO: 8623 - protein, 226 aa, Homo sapiens; identical to SEQ ID NO: 8606
  Payload ID: 1783;
  Gene Symbol: BAG6;
  Gene Name: BCL2-associated athanogene 6;
  ENSP ID: ENSP00000394801
  MOD_RES (1)..(1): Any amino acid

SEQ ID NO: 8624 - protein, 1126 aa, Homo sapiens
  Payload ID: 1783;
  Gene Symbol: BAG6;
  Gene Name: BCL2-associated athanogene 6;
  ENSP ID: ENSP00000394839
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 8625 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000394856

SEQ ID NO: 8626 - protein, 215 aa, Homo sapiens; identical to SEQ ID NO: 8608
  Payload ID: 1783;
  Gene Symbol: BAG6;
  Gene Name: BCL2-associated athanogene 6;
  ENSP ID: ENSP00000395063

SEQ ID NO: 8627 - protein, 206 aa, Homo sapiens; identical to SEQ ID NO: 8597
  Payload ID: 1783;
  Gene Symbol: BAG6;
  Gene Name: BCL2-associated athanogene 6;
  ENSP ID: ENSP00000395856

SEQ ID NO: 8628 - protein, 238 aa, Homo sapiens; identical to SEQ ID NO: 8593
  Payload ID: 1783;
  Gene Symbol: BAG6;
  Gene Name: BCL2-associated athanogene 6;
  ENSP ID: ENSP00000396028

SEQ ID NO: 8629 - protein, 515 aa, Homo sapiens
  Payload ID: 1783;
  Gene Symbol: BAG6;
  Gene Name: BCL2-associated athanogene 6;
  ENSP ID: ENSP00000396036
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGSTLIQLPSLPPEFMHAVAHQITHQAMVAAVAS

SEQ ID NO: 8630 - protein, 238 aa, Homo sapiens; identical to SEQ ID NO: 8612
  Payload ID: 1783;
  Gene Symbol: BAG6;
  Gene Name: BCL2-associated athanogene 6;
  ENSP ID: ENSP00000396284

SEQ ID NO: 8631 - protein, 158 aa, Homo sapiens; identical to SEQ ID NO: 8598
  Payload ID: 1783;
  Gene Symbol: BAG6;
  Gene Name: BCL2-associated athanogene 6;
  ENSP ID: ENSP00000396503

SEQ ID NO: 8632 - protein, 245 aa, Homo sapiens
  Payload ID: 1783;
  Gene Symbol: BAG6;
  Gene Name: BCL2-associated athanogene 6;
  ENSP ID: ENSP00000396893
PPRHLHVVRPMSHYTTPMVLQQAAIPIQINVGTTVTMTGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMP

SEQ ID NO: 8633 - protein, 245 aa, Homo sapiens
  Payload ID: 1783;
  Gene Symbol: BAG6;
  Gene Name: BCL2-associated athanogene 6;
  ENSP ID: ENSP00000397008
PPRHLHVVRPMSHYTTPMVLQQAAIPIQINVGTTVTMTGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGSGVASPTITVAMP

SEQ ID NO: 8634 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000397639

SEQ ID NO: 8635 - protein, 185 aa, Homo sapiens; identical to SEQ ID NO: 8604
  Payload ID: 1783;
  Gene Symbol: BAG6;
  Gene Name: BCL2-associated athanogene 6;
  ENSP ID: ENSP00000397702
  MOD_RES (1)..(1): Any amino acid

SEQ ID NO: 8636 - protein, 1132 aa, Homo sapiens; identical to SEQ ID NO: 8583
  Payload ID: 1783;
  Gene Symbol: BAG6;
  Gene Name: BCL2-associated athanogene 6;
  Uniprot ID:  P46379;
  ENSP ID: ENSP00000397894

SEQ ID NO: 8637 - protein, 259 aa, Homo sapiens; identical to SEQ ID NO: 8589
  Payload ID: 1783;
  Gene Symbol: BAG6;
  Gene Name: BCL2-associated athanogene 6;
  ENSP ID: ENSP00000397909

SEQ ID NO: 8638 - protein, 742 aa, Homo sapiens; identical to SEQ ID NO: 8599
  Payload ID: 1783;
  Gene Symbol: BAG6;
  Gene Name: BCL2-associated athanogene 6;
  ENSP ID: ENSP00000397978

SEQ ID NO: 8639 - protein, 245 aa, Homo sapiens; identical to SEQ ID NO: 8632
  Payload ID: 1783;
  Gene Symbol: BAG6;
  Gene Name: BCL2-associated athanogene 6;
  ENSP ID: ENSP00000398389

SEQ ID NO: 8640 - protein, 226 aa, Homo sapiens; identical to SEQ ID NO: 8606
  Payload ID: 1783;
  Gene Symbol: BAG6;
  Gene Name: BCL2-associated athanogene 6;
  ENSP ID: ENSP00000398547
  MOD_RES (1)..(1): Any amino acid

SEQ ID NO: 8641 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000399312

SEQ ID NO: 8642 - protein, 206 aa, Homo sapiens; identical to SEQ ID NO: 8597
  Payload ID: 1783;
  Gene Symbol: BAG6;
  Gene Name: BCL2-associated athanogene 6;
  ENSP ID: ENSP00000399508

SEQ ID NO: 8643 - protein, 185 aa, Homo sapiens; identical to SEQ ID NO: 8604
  Payload ID: 1783;
  Gene Symbol: BAG6;
  Gene Name: BCL2-associated athanogene 6;
  ENSP ID: ENSP00000399785
  MOD_RES (1)..(1): Any amino acid

SEQ ID NO: 8644 - protein, 515 aa, Homo sapiens; identical to SEQ ID NO: 8629
  Payload ID: 1783;
  Gene Symbol: BAG6;
  Gene Name: BCL2-associated athanogene 6;
  ENSP ID: ENSP00000399946

SEQ ID NO: 8645 - protein, 742 aa, Homo sapiens; identical to SEQ ID NO: 8599
  Payload ID: 1783;
  Gene Symbol: BAG6;
  Gene Name: BCL2-associated athanogene 6;
  ENSP ID: ENSP00000400275

SEQ ID NO: 8646 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000400353

SEQ ID NO: 8647 - protein, 206 aa, Homo sapiens; identical to SEQ ID NO: 8597
  Payload ID: 1783;
  Gene Symbol: BAG6;
  Gene Name: BCL2-associated athanogene 6;
  ENSP ID: ENSP00000400611

SEQ ID NO: 8648 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000400641

SEQ ID NO: 8649 - protein, 158 aa, Homo sapiens; identical to SEQ ID NO: 8598
  Payload ID: 1783;
  Gene Symbol: BAG6;
  Gene Name: BCL2-associated athanogene 6;
  ENSP ID: ENSP00000400877

SEQ ID NO: 8650 - protein, 158 aa, Homo sapiens; identical to SEQ ID NO: 8598
  Payload ID: 1783;
  Gene Symbol: BAG6;
  Gene Name: BCL2-associated athanogene 6;
  ENSP ID: ENSP00000400968

SEQ ID NO: 8651 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000401031

SEQ ID NO: 8652 - protein, 206 aa, Homo sapiens; identical to SEQ ID NO: 8597
  Payload ID: 1783;
  Gene Symbol: BAG6;
  Gene Name: BCL2-associated athanogene 6;
  ENSP ID: ENSP00000401218

SEQ ID NO: 8653 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000401440

SEQ ID NO: 8654 - protein, 245 aa, Homo sapiens; identical to SEQ ID NO: 8633
  Payload ID: 1783;
  Gene Symbol: BAG6;
  Gene Name: BCL2-associated athanogene 6;
  ENSP ID: ENSP00000402429

SEQ ID NO: 8655 - protein, 742 aa, Homo sapiens; identical to SEQ ID NO: 8594
  Payload ID: 1783;
  Gene Symbol: BAG6;
  Gene Name: BCL2-associated athanogene 6;
  ENSP ID: ENSP00000402441

SEQ ID NO: 8656 - protein, 258 aa, Homo sapiens; identical to SEQ ID NO: 8596
  Payload ID: 1783;
  Gene Symbol: BAG6;
  Gene Name: BCL2-associated athanogene 6;
  ENSP ID: ENSP00000402585

SEQ ID NO: 8657 - protein, 903 aa, Homo sapiens
  Payload ID: 1783;
  Gene Symbol: BAG6;
  Gene Name: BCL2-associated athanogene 6;
  Uniprot ID:  P46379;
  ENSP ID: ENSP00000402856
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLGAGLGTNASLAQMVSGLVGQLLMQPVLVAQGTPGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQEWVPIIQQDIQSQRKVKPQPPLSDAYLSGMPAKRRKLRSDIQKRLQEDPNYSPQRFPNAQRAFADDP

SEQ ID NO: 8658 - protein, 515 aa, Homo sapiens; identical to SEQ ID NO: 8629
  Payload ID: 1783;
  Gene Symbol: BAG6;
  Gene Name: BCL2-associated athanogene 6;
  ENSP ID: ENSP00000402863

SEQ ID NO: 8659 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000403166

SEQ ID NO: 8660 - protein, 515 aa, Homo sapiens; identical to SEQ ID NO: 8629
  Payload ID: 1783;
  Gene Symbol: BAG6;
  Gene Name: BCL2-associated athanogene 6;
  ENSP ID: ENSP00000403275

SEQ ID NO: 8661 - protein, 258 aa, Homo sapiens; identical to SEQ ID NO: 8596
  Payload ID: 1783;
  Gene Symbol: BAG6;
  Gene Name: BCL2-associated athanogene 6;
  ENSP ID: ENSP00000403277

SEQ ID NO: 8662 - protein, 515 aa, Homo sapiens; identical to SEQ ID NO: 8629
  Payload ID: 1783;
  Gene Symbol: BAG6;
  Gene Name: BCL2-associated athanogene 6;
  ENSP ID: ENSP00000403292

SEQ ID NO: 8663 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000403436

SEQ ID NO: 8664 - protein, 1126 aa, Homo sapiens; identical to SEQ ID NO: 8624
  Payload ID: 1783;
  Gene Symbol: BAG6;
  Gene Name: BCL2-associated athanogene 6;
  ENSP ID: ENSP00000403652

SEQ ID NO: 8665 - protein, 515 aa, Homo sapiens; identical to SEQ ID NO: 8629
  Payload ID: 1783;
  Gene Symbol: BAG6;
  Gene Name: BCL2-associated athanogene 6;
  ENSP ID: ENSP00000404299

SEQ ID NO: 8666 - protein, 158 aa, Homo sapiens; identical to SEQ ID NO: 8598
  Payload ID: 1783;
  Gene Symbol: BAG6;
  Gene Name: BCL2-associated athanogene 6;
  ENSP ID: ENSP00000404578

SEQ ID NO: 8667 - protein, 215 aa, Homo sapiens; identical to SEQ ID NO: 8608
  Payload ID: 1783;
  Gene Symbol: BAG6;
  Gene Name: BCL2-associated athanogene 6;
  ENSP ID: ENSP00000404703

SEQ ID NO: 8668 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000404813

SEQ ID NO: 8669 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000404971

SEQ ID NO: 8670 - protein, 197 aa, Homo sapiens; identical to SEQ ID NO: 8592
  Payload ID: 1783;
  Gene Symbol: BAG6;
  Gene Name: BCL2-associated athanogene 6;
  ENSP ID: ENSP00000405371

SEQ ID NO: 8671 - protein, 243 aa, Homo sapiens; identical to SEQ ID NO: 8605
  Payload ID: 1783;
  Gene Symbol: BAG6;
  Gene Name: BCL2-associated athanogene 6;
  ENSP ID: ENSP00000405607

SEQ ID NO: 8672 - protein, 185 aa, Homo sapiens; identical to SEQ ID NO: 8604
  Payload ID: 1783;
  Gene Symbol: BAG6;
  Gene Name: BCL2-associated athanogene 6;
  ENSP ID: ENSP00000405644
  MOD_RES (1)..(1): Any amino acid

SEQ ID NO: 8673 - protein, 742 aa, Homo sapiens; identical to SEQ ID NO: 8599
  Payload ID: 1783;
  Gene Symbol: BAG6;
  Gene Name: BCL2-associated athanogene 6;
  ENSP ID: ENSP00000405731

SEQ ID NO: 8674 - protein, 259 aa, Homo sapiens; identical to SEQ ID NO: 8589
  Payload ID: 1783;
  Gene Symbol: BAG6;
  Gene Name: BCL2-associated athanogene 6;
  ENSP ID: ENSP00000405744

SEQ ID NO: 8675 - protein, 238 aa, Homo sapiens; identical to SEQ ID NO: 8593
  Payload ID: 1783;
  Gene Symbol: BAG6;
  Gene Name: BCL2-associated athanogene 6;
  ENSP ID: ENSP00000406001

SEQ ID NO: 8676 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000406111

SEQ ID NO: 8677 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000406240

SEQ ID NO: 8678 - protein, 206 aa, Homo sapiens; identical to SEQ ID NO: 8597
  Payload ID: 1783;
  Gene Symbol: BAG6;
  Gene Name: BCL2-associated athanogene 6;
  ENSP ID: ENSP00000406302

SEQ ID NO: 8679 - protein, 243 aa, Homo sapiens; identical to SEQ ID NO: 8605
  Payload ID: 1783;
  Gene Symbol: BAG6;
  Gene Name: BCL2-associated athanogene 6;
  ENSP ID: ENSP00000406319

SEQ ID NO: 8680 - protein, 185 aa, Homo sapiens; identical to SEQ ID NO: 8604
  Payload ID: 1783;
  Gene Symbol: BAG6;
  Gene Name: BCL2-associated athanogene 6;
  ENSP ID: ENSP00000406434
  MOD_RES (1)..(1): Any amino acid

SEQ ID NO: 8681 - protein, 197 aa, Homo sapiens; identical to SEQ ID NO: 8592
  Payload ID: 1783;
  Gene Symbol: BAG6;
  Gene Name: BCL2-associated athanogene 6;
  ENSP ID: ENSP00000406436

SEQ ID NO: 8682 - protein, 215 aa, Homo sapiens; identical to SEQ ID NO: 8608
  Payload ID: 1783;
  Gene Symbol: BAG6;
  Gene Name: BCL2-associated athanogene 6;
  ENSP ID: ENSP00000406589

SEQ ID NO: 8683 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000406766

SEQ ID NO: 8684 - protein, 258 aa, Homo sapiens; identical to SEQ ID NO: 8596
  Payload ID: 1783;
  Gene Symbol: BAG6;
  Gene Name: BCL2-associated athanogene 6;
  ENSP ID: ENSP00000406914

SEQ ID NO: 8685 - protein, 158 aa, Homo sapiens; identical to SEQ ID NO: 8598
  Payload ID: 1783;
  Gene Symbol: BAG6;
  Gene Name: BCL2-associated athanogene 6;
  ENSP ID: ENSP00000407060

SEQ ID NO: 8686 - protein, 232 aa, Homo sapiens; identical to SEQ ID NO: 8603
  Payload ID: 1783;
  Gene Symbol: BAG6;
  Gene Name: BCL2-associated athanogene 6;
  ENSP ID: ENSP00000407175

SEQ ID NO: 8687 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000407212

SEQ ID NO: 8688 - protein, 232 aa, Homo sapiens; identical to SEQ ID NO: 8603
  Payload ID: 1783;
  Gene Symbol: BAG6;
  Gene Name: BCL2-associated athanogene 6;
  ENSP ID: ENSP00000407297

SEQ ID NO: 8689 - protein, 243 aa, Homo sapiens; identical to SEQ ID NO: 8605
  Payload ID: 1783;
  Gene Symbol: BAG6;
  Gene Name: BCL2-associated athanogene 6;
  ENSP ID: ENSP00000407500

SEQ ID NO: 8690 - protein, 197 aa, Homo sapiens; identical to SEQ ID NO: 8592
  Payload ID: 1783;
  Gene Symbol: BAG6;
  Gene Name: BCL2-associated athanogene 6;
  ENSP ID: ENSP00000407668

SEQ ID NO: 8691 - protein, 136 aa, Homo sapiens; identical to SEQ ID NO: 8609
  Payload ID: 1783;
  Gene Symbol: BAG6;
  Gene Name: BCL2-associated athanogene 6;
  ENSP ID: ENSP00000407701
  MOD_RES (1)..(1): Any amino acid

SEQ ID NO: 8692 - protein, 1126 aa, Homo sapiens; identical to SEQ ID NO: 8624
  Payload ID: 1783;
  Gene Symbol: BAG6;
  Gene Name: BCL2-associated athanogene 6;
  ENSP ID: ENSP00000407867

SEQ ID NO: 8693 - protein, 197 aa, Homo sapiens; identical to SEQ ID NO: 8592
  Payload ID: 1783;
  Gene Symbol: BAG6;
  Gene Name: BCL2-associated athanogene 6;
  ENSP ID: ENSP00000408125

SEQ ID NO: 8694 - protein, 215 aa, Homo sapiens; identical to SEQ ID NO: 8608
  Payload ID: 1783;
  Gene Symbol: BAG6;
  Gene Name: BCL2-associated athanogene 6;
  ENSP ID: ENSP00000408363

SEQ ID NO: 8695 - protein, 1126 aa, Homo sapiens; identical to SEQ ID NO: 8624
  Payload ID: 1783;
  Gene Symbol: BAG6;
  Gene Name: BCL2-associated athanogene 6;
  ENSP ID: ENSP00000408554

SEQ ID NO: 8696 - protein, 232 aa, Homo sapiens; identical to SEQ ID NO: 8603
  Payload ID: 1783;
  Gene Symbol: BAG6;
  Gene Name: BCL2-associated athanogene 6;
  ENSP ID: ENSP00000408565

SEQ ID NO: 8697 - protein, 136 aa, Homo sapiens; identical to SEQ ID NO: 8609
  Payload ID: 1783;
  Gene Symbol: BAG6;
  Gene Name: BCL2-associated athanogene 6;
  ENSP ID: ENSP00000408761
  MOD_RES (1)..(1): Any amino acid

SEQ ID NO: 8698 - protein, 136 aa, Homo sapiens; identical to SEQ ID NO: 8609
  Payload ID: 1783;
  Gene Symbol: BAG6;
  Gene Name: BCL2-associated athanogene 6;
  ENSP ID: ENSP00000408946
  MOD_RES (1)..(1): Any amino acid

SEQ ID NO: 8699 - protein, 742 aa, Homo sapiens; identical to SEQ ID NO: 8594
  Payload ID: 1783;
  Gene Symbol: BAG6;
  Gene Name: BCL2-associated athanogene 6;
  ENSP ID: ENSP00000409057

SEQ ID NO: 8700 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000409196

SEQ ID NO: 8701 - protein, 226 aa, Homo sapiens; identical to SEQ ID NO: 8606
  Payload ID: 1783;
  Gene Symbol: BAG6;
  Gene Name: BCL2-associated athanogene 6;
  ENSP ID: ENSP00000409254
  MOD_RES (1)..(1): Any amino acid

SEQ ID NO: 8702 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000409846

SEQ ID NO: 8703 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000409947

SEQ ID NO: 8704 - protein, 1126 aa, Homo sapiens; identical to SEQ ID NO: 8582
  Payload ID: 1783;
  Gene Symbol: BAG6;
  Gene Name: BCL2-associated athanogene 6;
  Uniprot ID:  P46379;
  ENSP ID: ENSP00000410156

SEQ ID NO: 8705 - protein, 215 aa, Homo sapiens; identical to SEQ ID NO: 8608
  Payload ID: 1783;
  Gene Symbol: BAG6;
  Gene Name: BCL2-associated athanogene 6;
  ENSP ID: ENSP00000410232

SEQ ID NO: 8706 - protein, 238 aa, Homo sapiens; identical to SEQ ID NO: 8612
  Payload ID: 1783;
  Gene Symbol: BAG6;
  Gene Name: BCL2-associated athanogene 6;
  ENSP ID: ENSP00000410280

SEQ ID NO: 8707 - protein, 232 aa, Homo sapiens; identical to SEQ ID NO: 8603
  Payload ID: 1783;
  Gene Symbol: BAG6;
  Gene Name: BCL2-associated athanogene 6;
  ENSP ID: ENSP00000410308

SEQ ID NO: 8708 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000410343

SEQ ID NO: 8709 - protein, 238 aa, Homo sapiens; identical to SEQ ID NO: 8612
  Payload ID: 1783;
  Gene Symbol: BAG6;
  Gene Name: BCL2-associated athanogene 6;
  ENSP ID: ENSP00000410644

SEQ ID NO: 8710 - protein, 258 aa, Homo sapiens; identical to SEQ ID NO: 8596
  Payload ID: 1783;
  Gene Symbol: BAG6;
  Gene Name: BCL2-associated athanogene 6;
  ENSP ID: ENSP00000411043

SEQ ID NO: 8711 - protein, 515 aa, Homo sapiens; identical to SEQ ID NO: 8629
  Payload ID: 1783;
  Gene Symbol: BAG6;
  Gene Name: BCL2-associated athanogene 6;
  ENSP ID: ENSP00000411083

SEQ ID NO: 8712 - protein, 197 aa, Homo sapiens; identical to SEQ ID NO: 8592
  Payload ID: 1783;
  Gene Symbol: BAG6;
  Gene Name: BCL2-associated athanogene 6;
  ENSP ID: ENSP00000411412

SEQ ID NO: 8713 - protein, 245 aa, Homo sapiens; identical to SEQ ID NO: 8633
  Payload ID: 1783;
  Gene Symbol: BAG6;
  Gene Name: BCL2-associated athanogene 6;
  ENSP ID: ENSP00000411460

SEQ ID NO: 8714 - protein, 1126 aa, Homo sapiens; identical to SEQ ID NO: 8582
  Payload ID: 1783;
  Gene Symbol: BAG6;
  Gene Name: BCL2-associated athanogene 6;
  Uniprot ID:  P46379;
  ENSP ID: ENSP00000412110

SEQ ID NO: 8715 - protein, 136 aa, Homo sapiens; identical to SEQ ID NO: 8609
  Payload ID: 1783;
  Gene Symbol: BAG6;
  Gene Name: BCL2-associated athanogene 6;
  ENSP ID: ENSP00000412274
  MOD_RES (1)..(1): Any amino acid

SEQ ID NO: 8716 - protein, 136 aa, Homo sapiens; identical to SEQ ID NO: 8609
  Payload ID: 1783;
  Gene Symbol: BAG6;
  Gene Name: BCL2-associated athanogene 6;
  ENSP ID: ENSP00000413225
  MOD_RES (1)..(1): Any amino acid

SEQ ID NO: 8717 - protein, 206 aa, Homo sapiens; identical to SEQ ID NO: 8597
  Payload ID: 1783;
  Gene Symbol: BAG6;
  Gene Name: BCL2-associated athanogene 6;
  ENSP ID: ENSP00000413317

SEQ ID NO: 8718 - protein, 1132 aa, Homo sapiens
  Payload ID: 1783;
  Gene Symbol: BAG6;
  Gene Name: BCL2-associated athanogene 6;
  ENSP ID: ENSP00000413327
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 8719 - protein, 1132 aa, Homo sapiens; identical to SEQ ID NO: 8718
  Payload ID: 1783;
  Gene Symbol: BAG6;
  Gene Name: BCL2-associated athanogene 6;
  ENSP ID: ENSP00000413341

SEQ ID NO: 8720 - protein, 185 aa, Homo sapiens; identical to SEQ ID NO: 8604
  Payload ID: 1783;
  Gene Symbol: BAG6;
  Gene Name: BCL2-associated athanogene 6;
  ENSP ID: ENSP00000413422
  MOD_RES (1)..(1): Any amino acid

SEQ ID NO: 8721 - protein, 245 aa, Homo sapiens; identical to SEQ ID NO: 8632
  Payload ID: 1783;
  Gene Symbol: BAG6;
  Gene Name: BCL2-associated athanogene 6;
  ENSP ID: ENSP00000413551

SEQ ID NO: 8722 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000413561

SEQ ID NO: 8723 - protein, 1126 aa, Homo sapiens; identical to SEQ ID NO: 8582
  Payload ID: 1783;
  Gene Symbol: BAG6;
  Gene Name: BCL2-associated athanogene 6;
  Uniprot ID:  P46379;
  ENSP ID: ENSP00000413698

SEQ ID NO: 8724 - protein, 226 aa, Homo sapiens; identical to SEQ ID NO: 8606
  Payload ID: 1783;
  Gene Symbol: BAG6;
  Gene Name: BCL2-associated athanogene 6;
  ENSP ID: ENSP00000414148
  MOD_RES (1)..(1): Any amino acid

SEQ ID NO: 8725 - protein, 243 aa, Homo sapiens; identical to SEQ ID NO: 8605
  Payload ID: 1783;
  Gene Symbol: BAG6;
  Gene Name: BCL2-associated athanogene 6;
  ENSP ID: ENSP00000414697

SEQ ID NO: 8726 - protein, 258 aa, Homo sapiens; identical to SEQ ID NO: 8596
  Payload ID: 1783;
  Gene Symbol: BAG6;
  Gene Name: BCL2-associated athanogene 6;
  ENSP ID: ENSP00000414702

SEQ ID NO: 8727 - protein, 244 aa, Homo sapiens; identical to SEQ ID NO: 8614
  Payload ID: 1783;
  Gene Symbol: BAG6;
  Gene Name: BCL2-associated athanogene 6;
  ENSP ID: ENSP00000414815

SEQ ID NO: 8728 - protein, 1126 aa, Homo sapiens; identical to SEQ ID NO: 8624
  Payload ID: 1783;
  Gene Symbol: BAG6;
  Gene Name: BCL2-associated athanogene 6;
  ENSP ID: ENSP00000415330

SEQ ID NO: 8729 - protein, 1132 aa, Homo sapiens; identical to SEQ ID NO: 8718
  Payload ID: 1783;
  Gene Symbol: BAG6;
  Gene Name: BCL2-associated athanogene 6;
  ENSP ID: ENSP00000415427

SEQ ID NO: 8730 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000416326

SEQ ID NO: 8731 - protein, 1126 aa, Homo sapiens; identical to SEQ ID NO: 8624
  Payload ID: 1783;
  Gene Symbol: BAG6;
  Gene Name: BCL2-associated athanogene 6;
  ENSP ID: ENSP00000416540

SEQ ID NO: 8732 - protein, 226 aa, Homo sapiens; identical to SEQ ID NO: 8606
  Payload ID: 1783;
  Gene Symbol: BAG6;
  Gene Name: BCL2-associated athanogene 6;
  ENSP ID: ENSP00000416633
  MOD_RES (1)..(1): Any amino acid

SEQ ID NO: 8733 - protein, 262 aa, Homo sapiens; identical to SEQ ID NO: 8615
  Payload ID: 1783;
  Gene Symbol: BAG6;
  Gene Name: BCL2-associated athanogene 6;
  ENSP ID: ENSP00000416652

SEQ ID NO: 8734 - protein, 185 aa, Homo sapiens; identical to SEQ ID NO: 8604
  Payload ID: 1783;
  Gene Symbol: BAG6;
  Gene Name: BCL2-associated athanogene 6;
  ENSP ID: ENSP00000416816
  MOD_RES (1)..(1): Any amino acid

SEQ ID NO: 8735 - protein, 226 aa, Homo sapiens; identical to SEQ ID NO: 8606
  Payload ID: 1783;
  Gene Symbol: BAG6;
  Gene Name: BCL2-associated athanogene 6;
  ENSP ID: ENSP00000416989
  MOD_RES (1)..(1): Any amino acid

SEQ ID NO: 8736 - protein, 1077 aa, Homo sapiens; identical to SEQ ID NO: 8584
  Payload ID: 1783;
  Gene Symbol: BAG6;
  Gene Name: BCL2-associated athanogene 6;
  Uniprot ID:  P46379;
  ENSP ID: ENSP00000446525

SEQ ID NO: 8737 - protein, 1077 aa, Homo sapiens; identical to SEQ ID NO: 8584
  Payload ID: 1783;
  Gene Symbol: BAG6;
  Gene Name: BCL2-associated athanogene 6;
  Uniprot ID:  P46379;
  ENSP ID: ENSP00000447546

SEQ ID NO: 8738 - protein, 1077 aa, Homo sapiens; identical to SEQ ID NO: 8584
  Payload ID: 1783;
  Gene Symbol: BAG6;
  Gene Name: BCL2-associated athanogene 6;
  Uniprot ID:  P46379;
  ENSP ID: ENSP00000447946

SEQ ID NO: 8739 - protein, 1077 aa, Homo sapiens
  Payload ID: 1783;
  Gene Symbol: BAG6;
  Gene Name: BCL2-associated athanogene 6;
  ENSP ID: ENSP00000449266
MEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMECRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKLRSDIQKRLQEDPNYSPQRFPNAQRAFADDP

SEQ ID NO: 8740 - protein, 1077 aa, Homo sapiens; identical to SEQ ID NO: 8739
  Payload ID: 1783;
  Gene Symbol: BAG6;
  Gene Name: BCL2-associated athanogene 6;
  ENSP ID: ENSP00000449634

SEQ ID NO: 8741 - protein, 1077 aa, Homo sapiens; identical to SEQ ID NO: 8739
  Payload ID: 1783;
  Gene Symbol: BAG6;
  Gene Name: BCL2-associated athanogene 6;
  ENSP ID: ENSP00000449636

SEQ ID NO: 8742 - protein, 903 aa, Homo sapiens; identical to SEQ ID NO: 8657
  Payload ID: 1783;
  Gene Symbol: BAG6;
  Gene Name: BCL2-associated athanogene 6;
  Uniprot ID:  P46379;
  ENSP ID: ENSP00000477867

SEQ ID NO: 8743 - protein, 903 aa, Homo sapiens; identical to SEQ ID NO: 8657
  Payload ID: 1783;
  Gene Symbol: BAG6;
  Gene Name: BCL2-associated athanogene 6;
  Uniprot ID:  P46379;
  ENSP ID: ENSP00000477951

SEQ ID NO: 8744 - protein, 903 aa, Homo sapiens; identical to SEQ ID NO: 8657
  Payload ID: 1783;
  Gene Symbol: BAG6;
  Gene Name: BCL2-associated athanogene 6;
  Uniprot ID:  P46379;
  ENSP ID: ENSP00000478966

SEQ ID NO: 8745 - protein, 903 aa, Homo sapiens; identical to SEQ ID NO: 8657
  Payload ID: 1783;
  Gene Symbol: BAG6;
  Gene Name: BCL2-associated athanogene 6;
  Uniprot ID:  P46379;
  ENSP ID: ENSP00000479238

SEQ ID NO: 8746 - protein, 903 aa, Homo sapiens; identical to SEQ ID NO: 8657
  Payload ID: 1783;
  Gene Symbol: BAG6;
  Gene Name: BCL2-associated athanogene 6;
  Uniprot ID:  P46379;
  ENSP ID: ENSP00000482413

SEQ ID NO: 8747 - protein, 903 aa, Homo sapiens; identical to SEQ ID NO: 8657
  Payload ID: 1783;
  Gene Symbol: BAG6;
  Gene Name: BCL2-associated athanogene 6;
  Uniprot ID:  P46379;
  ENSP ID: ENSP00000484238

SEQ ID NO: 8748 - protein, 869 aa, Homo sapiens
  Payload ID: 1784;
  Gene Symbol: BCLAF1;
  Gene Name: BCL2-associated transcription factor 1;
  Uniprot ID:  Q9NYF8;
  ENSP ID: ENSP00000229446
MGRSNSRSHSSRSKSRSQSSSRSRSRSHSRKKRYRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFHDDRDDGVDYWAKRGRGRGTFQRGRGRFNFKKSGSSPKWTHDKYQGDGIVEDEEETMENNEEKKDRRKEEKE

SEQ ID NO: 8749 - protein, 869 aa, Homo sapiens; identical to SEQ ID NO: 8748
  Payload ID: 1784;
  Gene Symbol: BCLAF1;
  Gene Name: BCL2-associated transcription factor 1;
  Uniprot ID:  Q9NYF8;
  ENSP ID: ENSP00000376159

SEQ ID NO: 8750 - protein, 725 aa, Homo sapiens
  Payload ID: 1784;
  Gene Symbol: BCLAF1;
  Gene Name: BCL2-associated transcription factor 1;
  ENSP ID: ENSP00000431734
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRIDISPSTLRKHTRLAGEERVFKEENQKGDKKLRCDSADLRHDIDRRRKERSKERGDSKGSRESSGSRKQEKT

SEQ ID NO: 8751 - protein, 752 aa, Homo sapiens
  Payload ID: 1784;
  Gene Symbol: BCLAF1;
  Gene Name: BCL2-associated transcription factor 1;
  ENSP ID: ENSP00000433505
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKNVFVFYTAYGG

SEQ ID NO: 8752 - protein, 467 aa, Homo sapiens
  Payload ID: 1784;
  Gene Symbol: BCLAF1;
  Gene Name: BCL2-associated transcription factor 1;
  ENSP ID: ENSP00000433822
MGRSNSRSHSSRSKSRSQSSSRSRSRSHSRKKRYRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKGPGICFEMAKSMFQSKIAVERYRQS

SEQ ID NO: 8753 - protein, 918 aa, Homo sapiens
  Payload ID: 1784;
  Gene Symbol: BCLAF1;
  Gene Name: BCL2-associated transcription factor 1;
  Uniprot ID:  Q9NYF8;
  ENSP ID: ENSP00000434826
MGRSNSRSHSSRSKSRSQSSSRSRSRSHSRKKRYRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 8754 - protein, 920 aa, Homo sapiens
  Payload ID: 1784;
  Gene Symbol: BCLAF1;
  Gene Name: BCL2-associated transcription factor 1;
  Uniprot ID:  Q9NYF8;
  ENSP ID: ENSP00000435210
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 8755 - protein, 871 aa, Homo sapiens [sequence omitted]

SEQ ID NO: 8756 - protein, 750 aa, Homo sapiens
  Payload ID: 1784;
  Gene Symbol: BCLAF1;
  Gene Name: BCL2-associated transcription factor 1;
  ENSP ID: ENSP00000436142
MGRSNSRSHSSRSKSRSQSSSRSRSRSHSRKKRYRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKRFTDEESRVFLLDRGNTRDKEASKEKGSEKGRAEGEWEDQEALDYFSDKESGKQKFNDSEGDDTEETEDYRQFRKSVLADQGKSFATASHRNTEEEGLKYKSKVSLKGNRESDGFREEKNYKLKETGYVVERPSTTKDKHKEEDKNSERITVKKETQSPEQVKSEKLKDLFDYSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKNVFVFYTAYGG

SEQ ID NO: 8757 - protein, 752 aa, Homo sapiens; identical to SEQ ID NO: 8751
  Payload ID: 1784;
  Gene Symbol: BCLAF1;
  Gene Name: BCL2-associated transcription factor 1;
  ENSP ID: ENSP00000436216

SEQ ID NO: 8758 - protein, 747 aa, Homo sapiens
  Payload ID: 1784;
  Gene Symbol: BCLAF1;
  Gene Name: BCL2-associated transcription factor 1;
  Uniprot ID:  Q9NYF8;
  ENSP ID: ENSP00000436501
MGRSNSRSHSSRSKSRSQSSSRSRSRSHSRKKRYSSRSRSRTYSRSRSRDRMYSRDYRRDYRNNRGMRRPYGYRGRGRGYYQGGGGRYHRGGYRPVWNRRHSRSPRRGRSRSRSPKRRSVSSQRSRSRSRRSYRSSRSPRSSSSRSSSPYSKSPVSKRRGSQEKQTKKAEGEPQEESPLKSKSQEEPKDTFEHDPSESIDEFNKSSATSGDIWPGLSAYDNSPRSPHSPSPIATPPSQSSSCSDAPMLSTVHSAKNTPSQHSHSIQHSPERSGSGSVGNGSSRYSPSQNSPIHHIPSRRSPAKTIAPQNAPRDESRGRSSFYPDGGDQETAKTGKFLKSPPLHKNLDAREKSTFREESPLRIKMIASDSHRPEVKLKMAPVPLDDSNRPASLTKDRLLASTLVHSVKKEQEFRSIFDHIKLPQASKSTSESFIQHIVSLVHHVKEQYFKSAAMTLNERFTSYQKATEEHSTRQKSPEIHRRIDISPSTLRKHTRLAGEERVFKEENQKGDKKLRCDSADLRHDIDRRRKERSKERGDSKGSRESSGSRKQEKTPKDYKEYKSYKDDSKHKREQDHSRSSSSSASPSSPSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 8759 - protein, 118 aa, Homo sapiens
  Payload ID: 1784;
  Gene Symbol: BCLAF1;
  Gene Name: BCL2-associated transcription factor 1;
  ENSP ID: ENSP00000436913
QHSHSIQHSPERSGSGSVGNGSSRYSPSQNSPIHHIPSRRSPAKTIAPQNAPRDESRGRSSFYPDGGDQETAKTGKFLKRFTDEESRVFLLDRVPLYTRIWMHEKSLPSERKAHLGSK

SEQ ID NO: 8760 - protein, 187 aa, Homo sapiens
  Payload ID: 1784;
  Gene Symbol: BCLAF1;
  Gene Name: BCL2-associated transcription factor 1;
  ENSP ID: ENSP00000437018
  MOD_RES (1)..(1): Any amino acid
XGSRESSGSRKQEKTPKDYKEYKSYKDDSSREEKESKKEREEEFKTHHEMKEYSGFAGVSRPRGTFFRIRGRGRARGVFAGTNTGPNNSNTTFQKRPKEEEWDPEYTPKSKKYFLHDDRDDGVDYWAKRGRGRGTFQRGRGRFNFKKSGSSPKWTHDKYQGDGIVEDEEETMENNEEKKDRRKEEKE

SEQ ID NO: 8761 - protein, 126 aa, Homo sapiens
  Payload ID: 1784;
  Gene Symbol: BCLAF1;
  Gene Name: BCL2-associated transcription factor 1;
  ENSP ID: ENSP00000437333
  MOD_RES (1)..(1): Any amino acid
XDHSRSSSSSASPSSPSSREEKESKKEREEEFKTHHEMKEYSGFAGVSRPRGTFHDDRDDGVDYWAKRGRGRGTFQRGRGRFNFKKSGSSPKWTHDKYQGDGIVEDEEETMENNEEKKDRRKEEKE

SEQ ID NO: 8762 - protein, 752 aa, Homo sapiens; identical to SEQ ID NO: 8751
  Payload ID: 1784;
  Gene Symbol: BCLAF1;
  Gene Name: BCL2-associated transcription factor 1;
  ENSP ID: ENSP00000487249

SEQ ID NO: 8763 - protein, 192 aa, Homo sapiens
  Payload ID: 1785;
  Gene Symbol: BAX;
  Gene Name: BCL2-associated X prt;
  Uniprot ID:  Q07812;
  ENSP ID: ENSP00000263262
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 8764 - protein, 218 aa, Homo sapiens
  Payload ID: 1785;
  Gene Symbol: BAX;
  Gene Name: BCL2-associated X prt;
  Uniprot ID:  Q07812;
  ENSP ID: ENSP00000293288
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 8765 - protein, 143 aa, Homo sapiens
  Payload ID: 1785;
  Gene Symbol: BAX;
  Gene Name: BCL2-associated X prt;
  Uniprot ID:  Q07812;
  ENSP ID: ENSP00000346461
MDGSGEQPRGGGPTSSEQIMKTGALLLQGMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 8766 - protein, 164 aa, Homo sapiens
  Payload ID: 1785;
  Gene Symbol: BAX;
  Gene Name: BCL2-associated X prt;
  Uniprot ID:  Q07812;
  ENSP ID: ENSP00000348871
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKAGVKWRDLGSLQPLPPGFKRFTCLSIPRSWDYRPCAPRCRN

SEQ ID NO: 8767 - protein, 175 aa, Homo sapiens
  Payload ID: 1785;
  Gene Symbol: BAX;
  Gene Name: BCL2-associated X prt;
  ENSP ID: ENSP00000375744
MDGSGEQPRGGGFHPGSSRANGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 8768 - protein, 179 aa, Homo sapiens
  Payload ID: 1785;
  Gene Symbol: BAX;
  Gene Name: BCL2-associated X prt;
  Uniprot ID:  Q07812;
  ENSP ID: ENSP00000389971
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWTVTIFVAGVLTASLTIWKKMG

SEQ ID NO: 8769 - protein, 126 aa, Homo sapiens
  Payload ID: 1785;
  Gene Symbol: BAX;
  Gene Name: BCL2-associated X prt;
  ENSP ID: ENSP00000426184
  MOD_RES (1)..(1): Any amino acid
XGRVRGAAQRRGMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 8770 - protein, 41 aa, Homo sapiens
  Payload ID: 1785;
  Gene Symbol: BAX;
  Gene Name: BCL2-associated X prt;
  Uniprot ID:  Q07812;
  ENSP ID: ENSP00000426328
MDGSGEQPRGGVSSRIEQGEWGGRHPSWPWTRCLRMRPPRS

SEQ ID NO: 8771 - protein, 140 aa, Homo sapiens
  Payload ID: 1785;
  Gene Symbol: BAX;
  Gene Name: BCL2-associated X prt;
  ENSP ID: ENSP00000441413
MIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 8772 - protein, 160 aa, Homo sapiens
  Payload ID: 1786;
  Gene Symbol: BIK;
  Gene Name: BCL2-interacting killer (apoptosis-inducing);
  Uniprot ID:  Q13323;
  ENSP ID: ENSP00000216115
MSEVRPLSRDILMETLLYEQLLEPPTMEVLGMTDSEEDLDPMEDFDSLECMEGSDALALRLACIGDEMDVSLRAPRLAQLSEVAMHSLGLAFIYDQTEDIRDVLRSFMDGFTTLKENIMRFWRSPNPGSWVSCEQVLLALLLLLALLLPLLSGGLHLLLK

SEQ ID NO: 8773 - protein, 333 aa, Homo sapiens
  Payload ID: 1787;
  Gene Symbol: BCL2L2-PABPN1;
  Gene Name: BCL2L2-PABPN1 readthrough;
  Uniprot ID:  Q92843;
  ENSP ID: ENSP00000451320
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGWELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 8774 - protein, 333 aa, Homo sapiens; identical to SEQ ID NO: 8773
  Payload ID: 1787;
  Gene Symbol: BCL2L2-PABPN1;
  Gene Name: BCL2L2-PABPN1 readthrough;
  Uniprot ID:  Q92843;
  ENSP ID: ENSP00000452479

SEQ ID NO: 8775 - protein, 233 aa, Homo sapiens
  Payload ID: 1788;
  Gene Symbol: BCL2L1;
  Gene Name: BCL2-like 1;
  Uniprot ID:  Q07817;
  ENSP ID: ENSP00000302564
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 8776 - protein, 170 aa, Homo sapiens
  Payload ID: 1788;
  Gene Symbol: BCL2L1;
  Gene Name: BCL2-like 1;
  Uniprot ID:  Q07817;
  ENSP ID: ENSP00000365223
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQDTFVELYGNNAAAESRKGQERFNRWFLTGMTVAGVVLLGSLFSRK

SEQ ID NO: 8777 - protein, 233 aa, Homo sapiens; identical to SEQ ID NO: 8775
  Payload ID: 1788;
  Gene Symbol: BCL2L1;
  Gene Name: BCL2-like 1;
  Uniprot ID:  Q07817;
  ENSP ID: ENSP00000365230

SEQ ID NO: 8778 - protein, 181 aa, Homo sapiens
  Payload ID: 1788;
  Gene Symbol: BCL2L1;
  Gene Name: BCL2-like 1;
  ENSP ID: ENSP00000389688
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPW

SEQ ID NO: 8779 - protein, 188 aa, Homo sapiens
  Payload ID: 1788;
  Gene Symbol: BCL2L1;
  Gene Name: BCL2-like 1;
  ENSP ID: ENSP00000390760
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGW

SEQ ID NO: 8780 - protein, 188 aa, Homo sapiens; identical to SEQ ID NO: 8779
  Payload ID: 1788;
  Gene Symbol: BCL2L1;
  Gene Name: BCL2-like 1;
  ENSP ID: ENSP00000395545

SEQ ID NO: 8781 - protein, 48 aa, Homo sapiens
  Payload ID: 1788;
  Gene Symbol: BCL2L1;
  Gene Name: BCL2-like 1;
  ENSP ID: ENSP00000401173
MSQSNRELVVDFLSYKLSQKGYSWSQFSDVEENRTEAPEGTESEMETP

SEQ ID NO: 8782 - protein, 205 aa, Homo sapiens
  Payload ID: 1788;
  Gene Symbol: BCL2L1;
  Gene Name: BCL2-like 1;
  ENSP ID: ENSP00000406203
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRK

SEQ ID NO: 8783 - protein, 188 aa, Homo sapiens; identical to SEQ ID NO: 8779
  Payload ID: 1788;
  Gene Symbol: BCL2L1;
  Gene Name: BCL2-like 1;
  ENSP ID: ENSP00000411252

SEQ ID NO: 8784 - protein, 204 aa, Homo sapiens
  Payload ID: 1789;
  Gene Symbol: BCL2L10;
  Gene Name: BCL2-like 10 (apoptosis facilitator);
  Uniprot ID:  Q9HD36;
  ENSP ID: ENSP00000260442
MVDQLRERTTMADPLRERTELLLADYLGYCAREPGTPEPAPSTPEAAVLRSAAARLRQIHRSFFSAYLGYPGNRFELVALMADSVLSDSPGPTWGRVVTLVTFAGTLLERGPLVTARWKKWGFQPRLKEQEGDVARDCQRLVALLSSRLMGQHRAWLQAQGGWDGFCHFFRTPFPLAFWRKQLVQAFLSCLLTTAFIYLWTRLL

SEQ ID NO: 8785 - protein, 241 aa, Homo sapiens
  Payload ID: 1789;
  Gene Symbol: BCL2L10;
  Gene Name: BCL2-like 10 (apoptosis facilitator);
  ENSP ID: ENSP00000453562
MVDQLRERTTMADPLRERTELLLADYLGYCAREPGTPEPAPSTPEAAVLRSAAARLRQIHRSFFSAYLGYPGNRFELVALMADSVLSDSPGPTWGRVVTLVTFAGTLLERGPLVTARWKKWGFQPRLKEQEGDVARDCQRLVALLSSRLMGQHRAWLQAQGGWVSTRRTPGHGAGRAAGKRPRGWHGWLLSLLQDPLSTGFLEKTAGPGFSVMLVNNSLHLSLDTIIMSFKTFNPLLPAQL

SEQ ID NO: 8786 - protein, 138 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000309226
MAKQPSDVSSECDREGRQLQPAERPPQLRPGAPTSLQTEPQDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 8787 - protein, 112 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000338374
MAKQPSDVSSECDREGRQLQPAERPPQLRPGAPTSLQTEPQDRSPAPMSCDKSTQTPSPPCQAFNHYLSAMVVILEDIGDLSLCFGFIFTGLDLYGHHHSQDTEQLNHKDFS

SEQ ID NO: 8788 - protein, 98 aa, Homo sapiens
  Payload ID: 1790;
  Gene Symbol: BCL2L11;
  Gene Name: BCL2-like 11 (apoptosis facilitator);
  ENSP ID: ENSP00000350398
MAKQPSDVSSECDREGRQLQPAERPPQLRPGAPTSLQTEPQDRSPAPMSCDKSTQTPSPPCQAFNHYLSAMDDSAGSSLRIALHREVQWPLKWLAKSS

SEQ ID NO: 8789 - protein, 75 aa, Homo sapiens
  Payload ID: 1790;
  Gene Symbol: BCL2L11;
  Gene Name: BCL2-like 11 (apoptosis facilitator);
  ENSP ID: ENSP00000354879
MAKQPSDVSSECDREGRQLQPAERPPQLRPGAPTSLQTEPQVSLCHPGWSALVRSWLTATSNSQVQAVLLPQPPK

SEQ ID NO: 8790 - protein, 71 aa, Homo sapiens
  Payload ID: 1790;
  Gene Symbol: BCL2L11;
  Gene Name: BCL2-like 11 (apoptosis facilitator);
  ENSP ID: ENSP00000376941
MAKQPSDVSSECDREGRQLQPAERPPQLRPGAPTSLQTEPQGNPEGNHGGEGDSCPHGSPQGPLAPPASPG

SEQ ID NO: 8791 - protein, 198 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000376943
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 8792 - protein, 112 aa, Homo sapiens; identical to SEQ ID NO: 8787
  Payload ID: 1790;
  Gene Symbol: BCL2L11;
  Gene Name: BCL2-like 11 (apoptosis facilitator);
  Uniprot ID:  O43521;
  ENSP ID: ENSP00000384641

SEQ ID NO: 8793 - protein, 96 aa, Homo sapiens
  Payload ID: 1790;
  Gene Symbol: BCL2L11;
  Gene Name: BCL2-like 11 (apoptosis facilitator);
  ENSP ID: ENSP00000389225
KQPSDVSSECDREGRQLQPAERPPQLRPGAPTSLQTEPQDRSPAPMSCDKSTQTPSPPCQAFNHYLSAMDDSAGSSLRIALHREVQWPLKWLAKSS

SEQ ID NO: 8794 - protein, 82 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000391292
MAKQPSDVSSECDREGRQLQPAERPPQLRPGAPTSLQTEPQASMRQAEPADMRPEIWIAQELRRIGDEFNAYYARRMPLPPD

SEQ ID NO: 8795 - protein, 80 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000393781
MAKQPSDVSSECDREGRQLQPAERPPQLRPGAPTSLQTEPQDRSPAPMSCDKSTQTPSPPCQAFNHYLSAMVREIEEVVV

SEQ ID NO: 8796 - protein, 135 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000394640
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMANWD

SEQ ID NO: 8797 - protein, 109 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000401662
MAKQPSDVSSECDREGRQLQPAERPPQLRPGAPTSLQTEPQDRSPAPMSCDKSTQTPSPPCQAFNHYLSAMASMRQAEPADMRPEIWIAQELRRIGDEFNAYYARRLEK

SEQ ID NO: 8798 - protein, 140 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000403727
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMVREIEEVVV

SEQ ID NO: 8799 - protein, 85 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000411137
MAKQPSDVSSECDREGRQLQPAERPPQLRPGAPTSLQTEPQASMRQAEPADMRPEIWIAQELRRIGDEFNAYYARRLAKLLASST

SEQ ID NO: 8800 - protein, 122 aa, Homo sapiens
  Payload ID: 1790;
  Gene Symbol: BCL2L11;
  Gene Name: BCL2-like 11 (apoptosis facilitator);
  ENSP ID: ENSP00000411870
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQ

SEQ ID NO: 8801 - protein, 172 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000412892
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRMPLPPD

SEQ ID NO: 8802 - protein, 109 aa, Homo sapiens; identical to SEQ ID NO: 8797
  Payload ID: 1790;
  Gene Symbol: BCL2L11;
  Gene Name: BCL2-like 11 (apoptosis facilitator);
  Uniprot ID:  O43521;
  ENSP ID: ENSP00000478133

SEQ ID NO: 8803 - protein, 135 aa, Homo sapiens; identical to SEQ ID NO: 8796
  Payload ID: 1790;
  Gene Symbol: BCL2L11;
  Gene Name: BCL2-like 11 (apoptosis facilitator);
  Uniprot ID:  O43521;
  ENSP ID: ENSP00000479714

SEQ ID NO: 8804 - protein, 140 aa, Homo sapiens; identical to SEQ ID NO: 8798
  Payload ID: 1790;
  Gene Symbol: BCL2L11;
  Gene Name: BCL2-like 11 (apoptosis facilitator);
  Uniprot ID:  O43521;
  ENSP ID: ENSP00000481030

SEQ ID NO: 8805 - protein, 85 aa, Homo sapiens; identical to SEQ ID NO: 8799
  Payload ID: 1790;
  Gene Symbol: BCL2L11;
  Gene Name: BCL2-like 11 (apoptosis facilitator);
  Uniprot ID:  O43521;
  ENSP ID: ENSP00000481423

SEQ ID NO: 8806 - protein, 169 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000481652
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRLEK

SEQ ID NO: 8807 - protein, 172 aa, Homo sapiens; identical to SEQ ID NO: 8801
  Payload ID: 1790;
  Gene Symbol: BCL2L11;
  Gene Name: BCL2-like 11 (apoptosis facilitator);
  Uniprot ID:  O43521;
  ENSP ID: ENSP00000482175

SEQ ID NO: 8808 - protein, 135 aa, Homo sapiens
  Payload ID: 1790;
  Gene Symbol: BCL2L11;
  Gene Name: BCL2-like 11 (apoptosis facilitator);
  Uniprot ID:  O43521;
  ENSP ID: ENSP00000484360
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMGIFE

SEQ ID NO: 8809 - protein, 250 aa, Homo sapiens
  Payload ID: 1791;
  Gene Symbol: BCL2L12;
  Gene Name: BCL2-like 12 (proline rich);
  ENSP ID: ENSP00000246784
MAGSEELGLREDTLRVLAAFLRRGEAAGSPVPTPPRSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKLASDPALRSKLVRLSSDSFARLVELFCSRDDSSRPSRACPGPPPPSPEPLARLALAMELSRRVAGLGGTLAGLSVEHVHSFTPWIQAHGGWEGILAVSPVDLNLPLD

SEQ ID NO: 8810 - protein, 334 aa, Homo sapiens
  Payload ID: 1791;
  Gene Symbol: BCL2L12;
  Gene Name: BCL2-like 12 (proline rich);
  Uniprot ID:  Q9HB09;
  ENSP ID: ENSP00000246785
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKLASDPALRSKLVRLSSDSFARLVELFCSRDDSSRPSRACPGPPPPSPEPLARLALAMELSRRVAGLGGTLAGLSVEHVHSFTPWIQAHGGWEGILAVSPVDLNLPLD

SEQ ID NO: 8811 - protein, 333 aa, Homo sapiens
  Payload ID: 1791;
  Gene Symbol: BCL2L12;
  Gene Name: BCL2-like 12 (proline rich);
  Uniprot ID:  Q9HB09;
  ENSP ID: ENSP00000393803
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKLASDPALRSKLVRLSSDSFARLVELFCSRDDSSRPSRACPGPPPPSPEPLARLALAMELSRRVAGLGGTLAGLSVEHVHSFTPWIQAHGGWEGILAVSPVDLNLPLD

SEQ ID NO: 8812 - protein, 92 aa, Homo sapiens
  Payload ID: 1791;
  Gene Symbol: BCL2L12;
  Gene Name: BCL2-like 12 (proline rich);
  ENSP ID: ENSP00000469216
MAGSEELGLREDTLRVLAAFLRRGEAAGSPVPTPPRPSYSRLLCFGGPAAGTAGPRAAEISAQPRITGSPIDREGSHTAEAGGPAGGGGRSH

SEQ ID NO: 8813 - protein, 138 aa, Homo sapiens
  Payload ID: 1791;
  Gene Symbol: BCL2L12;
  Gene Name: BCL2-like 12 (proline rich);
  ENSP ID: ENSP00000470644
MAGSEELGLREDTLRVLAAFLRRGEAAGSPVPTPPRSPAQEEPTDFLSRLRRCLPCSLGRGAAPSESPRPCSLPIRPCYGLEPGPATPDFYALVAQRLEQLVQEQLKSPPSPGGHPGCFTRGLELAIGLSSFSEAATR

SEQ ID NO: 8814 - protein, 92 aa, Homo sapiens; identical to SEQ ID NO: 8812
  Payload ID: 1791;
  Gene Symbol: BCL2L12;
  Gene Name: BCL2-like 12 (proline rich);
  ENSP ID: ENSP00000471919

SEQ ID NO: 8815 - protein, 92 aa, Homo sapiens
  Payload ID: 1791;
  Gene Symbol: BCL2L12;
  Gene Name: BCL2-like 12 (proline rich);
  ENSP ID: ENSP00000472214
MAGSEELGLREDTLRVLAAFLRRGEAAGSPVPTPPRSPAQEEPTDFLSRLRRCLPCSLGVEHVHSFTPWIQAHGGWEGILAVSPVDLNLPLD

SEQ ID NO: 8816 - protein, 130 aa, Homo sapiens
  Payload ID: 1791;
  Gene Symbol: BCL2L12;
  Gene Name: BCL2-like 12 (proline rich);
  ENSP ID: ENSP00000478415
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRRASWLFHPWT

SEQ ID NO: 8817 - protein, 193 aa, Homo sapiens
  Payload ID: 1791;
  Gene Symbol: BCL2L12;
  Gene Name: BCL2-like 12 (proline rich);
  ENSP ID: ENSP00000482154
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGAAPSESPRPCSLPIRPCYGLEPGGHPGCFTRGLELAIGLSSFSEAATR

SEQ ID NO: 8818 - protein, 334 aa, Homo sapiens; identical to SEQ ID NO: 8810
  Payload ID: 1791;
  Gene Symbol: BCL2L12;
  Gene Name: BCL2-like 12 (proline rich);
  Uniprot ID:  Q9HB09;
  ENSP ID: ENSP00000482218

SEQ ID NO: 8819 - protein, 269 aa, Homo sapiens
  Payload ID: 1791;
  Gene Symbol: BCL2L12;
  Gene Name: BCL2-like 12 (proline rich);
  ENSP ID: ENSP00000483272
MGRPAGLFPPLCPFLGFRPEACWERHMQIERAPSVPPFLRWAGYRPGPVRRRGKVELIKFVRVQWRRPQVEWRRRRWGPGPGASMAGSEELGLREDTLRVLAAFLRRGEAAGSPVPTPPRSPAQEEPTDFLSRLRRCLPCSLGRGAAPSESPRPCSLPIRPCYGLEPGPATPDFYALVAQRLEQLVQEQLKSPPSPELQGPPSTEKEAILRRLVALLEEEAEVINQKVMGICPTPWQGQELRNGGHPGCFTRGLELAIGLSSFSEAATR

SEQ ID NO: 8820 - protein, 485 aa, Homo sapiens
  Payload ID: 1792;
  Gene Symbol: BCL2L13;
  Gene Name: BCL2-like 13 (apoptosis facilitator);
  Uniprot ID:  Q9BXK5;
  ENSP ID: ENSP00000318883
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 8821 - protein, 128 aa, Homo sapiens
  Payload ID: 1792;
  Gene Symbol: BCL2L13;
  Gene Name: BCL2-like 13 (apoptosis facilitator);
  ENSP ID: ENSP00000338932
MASSSTVPLGFHYETKYVVLSYLGLLSQEKLQEQHLSSPQGVQLDIASQSLDQEILLKVKTEIEEELKSLDKEISEDFGASGFATTNAFGIDKTWSRTFERTAAVWRDIPGGLFGRVHHSARWLGHCV

SEQ ID NO: 8822 - protein, 171 aa, Homo sapiens
  Payload ID: 1792;
  Gene Symbol: BCL2L13;
  Gene Name: BCL2-like 13 (apoptosis facilitator);
  ENSP ID: ENSP00000347133
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQALCLVLSQRRRNTLESLQKIAMTFTSCPATTLDKSVPQSLQL

SEQ ID NO: 8823 - protein, 38 aa, Homo sapiens
  Payload ID: 1792;
  Gene Symbol: BCL2L13;
  Gene Name: BCL2-like 13 (apoptosis facilitator);
  ENSP ID: ENSP00000382677
  MOD_RES (1)..(1): Any amino acid
XLGEKVSQELKEPLHKALQMLLSQFWCLWFCYDKCFWN

SEQ ID NO: 8824 - protein, 201 aa, Homo sapiens
  Payload ID: 1792;
  Gene Symbol: BCL2L13;
  Gene Name: BCL2-like 13 (apoptosis facilitator);
  Uniprot ID:  Q9BXK5;
  ENSP ID: ENSP00000382682
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWV

SEQ ID NO: 8825 - protein, 323 aa, Homo sapiens
  Payload ID: 1792;
  Gene Symbol: BCL2L13;
  Gene Name: BCL2-like 13 (apoptosis facilitator);
  Uniprot ID:  Q9BXK5;
  ENSP ID: ENSP00000410019
MLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 8826 - protein, 201 aa, Homo sapiens; identical to SEQ ID NO: 8824
  Payload ID: 1792;
  Gene Symbol: BCL2L13;
  Gene Name: BCL2-like 13 (apoptosis facilitator);
  Uniprot ID:  Q9BXK5;
  ENSP ID: ENSP00000434764

SEQ ID NO: 8827 - protein, 78 aa, Homo sapiens
  Payload ID: 1792;
  Gene Symbol: BCL2L13;
  Gene Name: BCL2-like 13 (apoptosis facilitator);
  ENSP ID: ENSP00000436321
MASSSTVPLGFHYETKYVVLSYLGLLSQEKLQEQHLSSPQGVQLDIASQSLDQEILLKVKTEIEEELKSLDKEISEGQ

SEQ ID NO: 8828 - protein, 323 aa, Homo sapiens; identical to SEQ ID NO: 8825
  Payload ID: 1792;
  Gene Symbol: BCL2L13;
  Gene Name: BCL2-like 13 (apoptosis facilitator);
  Uniprot ID:  Q9BXK5;
  ENSP ID: ENSP00000437667

SEQ ID NO: 8829 - protein, 92 aa, Homo sapiens
  Payload ID: 1792;
  Gene Symbol: BCL2L13;
  Gene Name: BCL2-like 13 (apoptosis facilitator);
  ENSP ID: ENSP00000441344
MASSSTVPLGFHYETKYVVLSYLGLLSQEKLQEQHLSSPQDFGASGFATTNAFGIDKTWSRTFERTAAVWRDIPGGLFGRVHHSARWLGHCV

SEQ ID NO: 8830 - protein, 461 aa, Homo sapiens
  Payload ID: 1792;
  Gene Symbol: BCL2L13;
  Gene Name: BCL2-like 13 (apoptosis facilitator);
  ENSP ID: ENSP00000477967
MSGSSGPAPTPAVTKARRGDLTLQHGGGGRLGPRVGALTAAGGPCRKQLPPPPLSSLLGQGPGPGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 8831 - protein, 80 aa, Homo sapiens
  Payload ID: 1792;
  Gene Symbol: BCL2L13;
  Gene Name: BCL2-like 13 (apoptosis facilitator);
  ENSP ID: ENSP00000480014
MASSSTVPLGFHYETKYVVLSYLGLLSQEKLQEQHLSSPQGVQLDIASQSLDQEILLKVKTEIEEELKSLDKEISEGHCV

SEQ ID NO: 8832 - protein, 509 aa, Homo sapiens
  Payload ID: 1792;
  Gene Symbol: BCL2L13;
  Gene Name: BCL2-like 13 (apoptosis facilitator);
  ENSP ID: ENSP00000480836
MSGSSGPAPTPAVTKARRGDLTLQHGGGGRLGPRVGALTAAGGPCRKQLPPPPLSSLLGQGPGPGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 8833 - protein, 252 aa, Homo sapiens
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000266434
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKDTAFIPIPLVDTSIQGFPQDGLMACI

SEQ ID NO: 8834 - protein, 276 aa, Homo sapiens
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000298566
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKEKEWEESAKTKIKMALLWRSSGGGPRVLSIPEAFMKNSFTLTPPGFSEHN

SEQ ID NO: 8835 - protein, 327 aa, Homo sapiens
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000309132
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKLKKDKALMGHFQDGLSYSVFKTITDQVLMGVDPRGESEVKAQGFKAALVIDVTAKLTAIDNHPMNRVLGFGTKYLKENFSPWIQQHGGWEKILGISHEEVD

SEQ ID NO: 8836 - protein, 327 aa, Homo sapiens; identical to SEQ ID NO: 8835
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000379653

SEQ ID NO: 8837 - protein, 57 aa, Homo sapiens
  Payload ID: 1793;
  Gene Symbol: BCL2L14;
  Gene Name: BCL2-like 14 (apoptosis facilitator);
  ENSP ID: ENSP00000417223
MCSTSGCDLEEIPLDDDDLNTIEFKILAYYTRHHVFKSTPALFSPKLLRTRSLSQRG

SEQ ID NO: 8838 - protein, 125 aa, Homo sapiens
  Payload ID: 1793;
  Gene Symbol: BCL2L14;
  Gene Name: BCL2-like 14 (apoptosis facilitator);
  ENSP ID: ENSP00000419617
MPNMCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEY

SEQ ID NO: 8839 - protein, 176 aa, Homo sapiens
  Payload ID: 1793;
  Gene Symbol: BCL2L14;
  Gene Name: BCL2-like 14 (apoptosis facilitator);
  ENSP ID: ENSP00000465663
MCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFK

SEQ ID NO: 8840 - protein, 360 aa, Homo sapiens
  Payload ID: 1793;
  Gene Symbol: BCL2L14;
  Gene Name: BCL2-like 14 (apoptosis facilitator);
  ENSP ID: ENSP00000466693
MGLSPCCPGWFQTPGHSLSSCLSLPKRWDCRPNMCSTSGCDLEEIPLDDDDLNTIEFKILAYYTRHHVFKSTPALFSPKLLRTRSLSQRGLGNCSANESWTEVSWPCRNSQSSEKAINLGKKKSSWKAFFGVVEKEDSQSTPAKVSAQGQRTLEYQDSHSQQWSRCLSNVEQCLEHEAVDPKVISIANRVAEIVYSWPPPQATQAGGFKSKEIFVTEGLSFQLQGHVPVASSSKKDEEEQILAKIVELLKYSGDQLERKLKKDKALMGHFQDGLSYSVFKTITDQVLMGVDPRGESEVKAQGFKAALVIDVTAKLTAIDNHPMNRVLGFGTKYLKENFSPWIQQHGGWEKILGISHEEVD

SEQ ID NO: 8841 - protein, 327 aa, Homo sapiens; identical to SEQ ID NO: 8835
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000467086

SEQ ID NO: 8842 - protein, 276 aa, Homo sapiens; identical to SEQ ID NO: 8834
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000485980

SEQ ID NO: 8843 - protein, 327 aa, Homo sapiens; identical to SEQ ID NO: 8835
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000486050

SEQ ID NO: 8844 - protein, 176 aa, Homo sapiens; identical to SEQ ID NO: 8839
  Payload ID: 1793;
  Gene Symbol: BCL2L14;
  Gene Name: BCL2-like 14 (apoptosis facilitator);
  ENSP ID: ENSP00000486273

SEQ ID NO: 8845 - protein, 252 aa, Homo sapiens; identical to SEQ ID NO: 8833
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000486560

SEQ ID NO: 8846 - protein, 360 aa, Homo sapiens; identical to SEQ ID NO: 8840
  Payload ID: 1793;
  Gene Symbol: BCL2L14;
  Gene Name: BCL2-like 14 (apoptosis facilitator);
  ENSP ID: ENSP00000486791

SEQ ID NO: 8847 - protein, 327 aa, Homo sapiens; identical to SEQ ID NO: 8835
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000486796

SEQ ID NO: 8848 - protein, 125 aa, Homo sapiens; identical to SEQ ID NO: 8838
  Payload ID: 1793;
  Gene Symbol: BCL2L14;
  Gene Name: BCL2-like 14 (apoptosis facilitator);
  ENSP ID: ENSP00000486862

SEQ ID NO: 8849 - protein, 327 aa, Homo sapiens; identical to SEQ ID NO: 8835
  Payload ID: 1793;
  Gene Symbol: BCL2L14;
  Gene Name: BCL2-like 14 (apoptosis facilitator);
  Uniprot ID:  Q9BZR8;
  ENSP ID: ENSP00000487330

SEQ ID NO: 8850 - protein, 57 aa, Homo sapiens; identical to SEQ ID NO: 8837
  Payload ID: 1793;
  Gene Symbol: BCL2L14;
  Gene Name: BCL2-like 14 (apoptosis facilitator);
  ENSP ID: ENSP00000487566

SEQ ID NO: 8851 - protein, 163 aa, Homo sapiens
  Payload ID: 1794;
  Gene Symbol: BCL2L15;
  Gene Name: BCL2-like 15;
  Uniprot ID:  Q5TBC7;
  ENSP ID: ENSP00000376992
MKSSQTFEEQTECIVNTLLMDFLSPTLQVASRNLCCVDEVDSGEPCSFDVAIIAGRLRMLGDQFNGELEASAKNVIAETIKGQTGAILQDTVESLSKTWCAQDSSLAYERAFLAVSVKLLEYMAHIAPEVVGQVAIPMTGMINGNQAIREFIQGQGGWENLES

SEQ ID NO: 8852 - protein, 56 aa, Homo sapiens
  Payload ID: 1794;
  Gene Symbol: BCL2L15;
  Gene Name: BCL2-like 15;
  Uniprot ID:  Q5TBC7;
  ENSP ID: ENSP00000376995
MKSSQTFEEQTECIVNTLLMDFLSPTLQVASRNLCCVDEVDSGKSGELKSWSYSRD

SEQ ID NO: 8853 - protein, 88 aa, Homo sapiens
  Payload ID: 1794;
  Gene Symbol: BCL2L15;
  Gene Name: BCL2-like 15;
  ENSP ID: ENSP00000417458
MKSSQTFEEQTECIVNTLLMDFLSPTLQVASRNLCCVDEVDSGEPCSFDVAIIAGRLRMLGDQFNGELEASAKNVIAETIKGQENLES

SEQ ID NO: 8854 - protein, 193 aa, Homo sapiens
  Payload ID: 1795;
  Gene Symbol: BCL2L2;
  Gene Name: BCL2-like 2;
  Uniprot ID:  Q92843;
  ENSP ID: ENSP00000250405
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGWAEFTALYGDGALEEARRLREGNWASVRTVLTGAVALGALVTVGAFFASK

SEQ ID NO: 8855 - protein, 51 aa, Homo sapiens
  Payload ID: 1795;
  Gene Symbol: BCL2L2;
  Gene Name: BCL2-like 2;
  ENSP ID: ENSP00000451148
MATPASAPDTRALVADFVGYKLRQKGYVCGAGPGEGPAADPLHQAMRAAGD

SEQ ID NO: 8856 - protein, 167 aa, Homo sapiens
  Payload ID: 1795;
  Gene Symbol: BCL2L2;
  Gene Name: BCL2-like 2;
  ENSP ID: ENSP00000451197
  MOD_RES (1)..(1): Any amino acid
XRTFSDLAAQLHVTPGSAQQRFTQVSDELFQGGPNWGRLVAFFVFGAALCAESVNKEMEPLVGQVQEWMVAYLETQLADWIHSSGGWAEFTALYGDGALEEARRLREGNWASVRTVLTGAVALGALVWSTLFTLPSTTGHISLLAFPGTFSQEELQGPWPGYQNALL

SEQ ID NO: 8857 - protein, 71 aa, Homo sapiens
  Payload ID: 1795;
  Gene Symbol: BCL2L2;
  Gene Name: BCL2-like 2;
  ENSP ID: ENSP00000451234
MATPASAPDTRALVADFVGYKLRQKGYVCGAGPGEGPAADPLHQAMRAAGDEFETRFRRTFSDLAAQLHVT

SEQ ID NO: 8858 - protein, 149 aa, Homo sapiens
  Payload ID: 1795;
  Gene Symbol: BCL2L2;
  Gene Name: BCL2-like 2;
  ENSP ID: ENSP00000451701
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGWAEFTA

SEQ ID NO: 8859 - protein, 144 aa, Homo sapiens
  Payload ID: 1795;
  Gene Symbol: BCL2L2;
  Gene Name: BCL2-like 2;
  ENSP ID: ENSP00000452265
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGW

SEQ ID NO: 8860 - protein, 212 aa, Homo sapiens
  Payload ID: 1796;
  Gene Symbol: BOK;
  Gene Name: BCL2-related ovarian killer;
  Uniprot ID:  Q9UMX3;
  ENSP ID: ENSP00000314132
MEVLRRSSVFAAEIMDAFDRSPTDKELVAQAKALGREYVHARLLRAGLSWSAPERAAPVPGRLAEVCAVLLRLGDELEMIRPSVYRNVARQLHISLQSEPVVTDAFLAVAGHIFSAGITWGKVVSLYAVAAGLAVDCVRQAQPAMVHALVDCLGEFVRKTLATWLRRRGGWTDVLKCVVSTDPGLRSHWLVAALCSFGRFLKAAFFVLLPER

SEQ ID NO: 8861 - protein, 175 aa, Homo sapiens
  Payload ID: 1797;
  Gene Symbol: BCL2A1;
  Gene Name: BCL2-related prt A1;
  Uniprot ID:  Q16548;
  ENSP ID: ENSP00000267953
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWENGFVKKFEPKSGWMTFLEVTGKICEMLSLLKQYC

SEQ ID NO: 8862 - protein, 163 aa, Homo sapiens
  Payload ID: 1797;
  Gene Symbol: BCL2A1;
  Gene Name: BCL2-related prt A1;
  Uniprot ID:  Q16548;
  ENSP ID: ENSP00000335250
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWGKWHNHTPMLVESVAHKKRKMAL

SEQ ID NO: 8863 - protein, 1721 aa, Homo sapiens
  Payload ID: 1798;
  Gene Symbol: BCOR;
  Gene Name: BCL6 corepressor;
  Uniprot ID:  Q6W2J9;
  ENSP ID: ENSP00000345923
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 8864 - protein, 1755 aa, Homo sapiens
  Payload ID: 1798;
  Gene Symbol: BCOR;
  Gene Name: BCL6 corepressor;
  Uniprot ID:  Q6W2J9;
  ENSP ID: ENSP00000367705
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKDDWPEREMTNSSSNHLEDPHYSELTNLKVCIELTGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 8865 - protein, 1703 aa, Homo sapiens
  Payload ID: 1798;
  Gene Symbol: BCOR;
  Gene Name: BCL6 corepressor;
  Uniprot ID:  Q6W2J9;
  ENSP ID: ENSP00000367716
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQRAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 8866 - protein, 622 aa, Homo sapiens
  Payload ID: 1798;
  Gene Symbol: BCOR;
  Gene Name: BCL6 corepressor;
  ENSP ID: ENSP00000367724
MPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYWKSPQIARGSVEGKKTDDKTSKTDL

SEQ ID NO: 8867 - protein, 1721 aa, Homo sapiens; identical to SEQ ID NO: 8863
  Payload ID: 1798;
  Gene Symbol: BCOR;
  Gene Name: BCL6 corepressor;
  Uniprot ID:  Q6W2J9;
  ENSP ID: ENSP00000380512

SEQ ID NO: 8868 - protein, 1287 aa, Homo sapiens
  Payload ID: 1798;
  Gene Symbol: BCOR;
  Gene Name: BCL6 corepressor;
  ENSP ID: ENSP00000384485
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQ

SEQ ID NO: 8869 - protein, 332 aa, Homo sapiens
  Payload ID: 1798;
  Gene Symbol: BCOR;
  Gene Name: BCL6 corepressor;
  ENSP ID: ENSP00000387552
QKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQG

SEQ ID NO: 8870 - protein, 28 aa, Homo sapiens
  Payload ID: 1798;
  Gene Symbol: BCOR;
  Gene Name: BCL6 corepressor;
  ENSP ID: ENSP00000390273
MLSATPLYGNVHSWMNSERVRMCGASED

SEQ ID NO: 8871 - protein, 289 aa, Homo sapiens
  Payload ID: 1798;
  Gene Symbol: BCOR;
  Gene Name: BCL6 corepressor;
  ENSP ID: ENSP00000403823
  MOD_RES (1)..(1): Any amino acid
XAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTGHETGYCFRMSLRN

SEQ ID NO: 8872 - protein, 594 aa, Homo sapiens
  Payload ID: 1798;
  Gene Symbol: BCOR;
  Gene Name: BCL6 corepressor;
  ENSP ID: ENSP00000408006
DKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPERSPLK

SEQ ID NO: 8873 - protein, 411 aa, Homo sapiens
  Payload ID: 1798;
  Gene Symbol: BCOR;
  Gene Name: BCL6 corepressor;
  ENSP ID: ENSP00000483217
MTRPAFQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQVSPPT

SEQ ID NO: 8874 - protein, 1711 aa, Homo sapiens
  Payload ID: 1799;
  Gene Symbol: BCORL1;
  Gene Name: BCL6 corepressor-like 1;
  Uniprot ID:  Q5H9F3;
  ENSP ID: ENSP00000218147
MISTAPLYSGVHNWTSSDRIRMCGINEERRAPLSDEESTTGDCQHFGSQEFCVSSSFSKVELTAVGSGSNARGADPDGSATEKLGHKSEDKPDDPQPKMDYAGNVAEAEGLLVPLSSPGDGLKLPASDSAEASNSRADCSWTPLNTQMSKQVDCSPAGVKALDSRQGVGEKNTFILATLGTGVPVEGTLPLVTTNFSPLPAPICPPAPGSASVPHSVPDAFQVPLSVPAPVPHSGLVPVQVATSVPAPSPPLAPVPALAPAPPSVPTLISDSNPLSVSASVLVPVPASAPPSGPVPLSAPAPAPLSVPVSAPPLALIQAPVPPSAPTLVLAPVPTPVLAPMPASTPPAAPAPPSVPMPTPTPSSGPPSTPTLIPAFAPTPVPAPTPAPIFTPAPTPMPAATPAAIPTSAPIPASFSLSRVCFPAAQAPAMQKVPLSFQPGTVLTPSQPLVYIPPPSCGQPLSVATLPTTLGVSSTLTLPVLPSYLQDRCLPGVLASPELRSYPYAFSVARPLTSDSKLVSLEVNRLPCTSPSGSTTTQPAPDGVPGPLADTSLVTASAKVLPTPQPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSGSICSSFAGMADSDMGSQEVFPTEEEEEVTPTPAKRRKVRKTQRDTQYRSHHAQDKSLLSQGRRHLWRAREMPWRTEAARQMWDTNEEEEEEEEEGLLKRKKRRRQKSRKYQTGEYLTEQEDEQRRKGRADLKARKQKTSSSQSLEHRLRNRNLLLPNKVQGISDSPNGFLPNNLEEPACLENSEKPSGKRKCKTKHMATVSEEAKDVVLYCLQKDSEDVNHRDNAGYTALHEACSRGWTDILNILLEHGANVNCSAQDGTRPVHDAVVNDNLETIWLLLSYGADPTLATYSGQTAMKLASSDTMKRFLSDHLSDLQGRAEGDPGVSWDFYSSSVLEEKDGFACDLLHNPPGSSDQEGDDPMEEDDFMFELSDKPLLPCYNLQVSVSRGPCNWFLFSDVLKRLKLSSRIFQARFPHFEITTMPKAEFYRQVASSQLLTPAERPGGLDDRSPPGSSETVELVRYEPDLLRLLGSEVEFQSCNS

SEQ ID NO: 8875 - protein, 1385 aa, Homo sapiens
  Payload ID: 1799;
  Gene Symbol: BCORL1;
  Gene Name: BCL6 corepressor-like 1;
  ENSP ID: ENSP00000399483
TPAAIPTSAPIPASFSLSRVCFPAAQAPAMQKVPLSFQPGTVLTPSQPLVYIPPPSCGQPLSVATLPTTLGVSSTLTLPVLPSYLQDRCLPGVLASPELRSYPYAFSVARPLTSDSKLVSLEVNRLPCTSPSGSTTTQPAPDGVPGPLADTSLVTASAKVLPTPQPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSGSICSSFAGMADSDMGSQEVFPTEEEEEVTPTPAKRRKVRKTQRDTQYRSHHAQDKSLLSQGRRHLWRAREMPWRTEAARQMWDTNEEEEEEEEEGLLKRKKRRRQKSRKYQTGEYLTEQEDEQRRKGRADLKARKQKTSSSQSLEHRLRNRNLLLPNKVQGISDSPNGFLPNNLEEPACLENSEKPSGKRKCKTKHMATVSEEAKGKGRWSQQKTRSPKSPTPVKPTEPCTPSKSRSASSEEASESPTARQIPPEARRLIVNKNAGETLLQRAARLGYKDVVLYCLQKDSEDVNHRDNAGYTALHEACSRGWTDILNILLEHGANVNCSAQDGTRPVHDAVVNDNLETIWLLLSYGADPTLATYSGQTAMKLASSDTMKRFLSDHLSDLQGRAEGDPGVSWDFYSSSVLEEKDGFACDLLHNPPGSSDQEGDDPMEEDDFMFELSDKPLLPCYNLQVSVSRGPCNWFLFSDVLKRLKLSSRIFQARFPHFEITTMPKAEFYRQVASSQLLTPAERPGGLDDRSPPGSSETVELVRYEPDLLRLLGSEVEFQSCNS

SEQ ID NO: 8876 - protein, 741 aa, Homo sapiens
  Payload ID: 1799;
  Gene Symbol: BCORL1;
  Gene Name: BCL6 corepressor-like 1;
  ENSP ID: ENSP00000416520
  MOD_RES (1)..(1): Any amino acid
XPLLPAPSGSSAPPHPAKMPSGTEQQTEGTSVTFSPLKSPPQLEREMASPPECSEMPLDLSSKSNRQKLPLPNQRKTPPMPVLTPVHTSSKALLSTVLSRSQRTTQAAGGNVTSCLGSTSSPFVIFPEIVRNGDPSTWVKNSTALISTIPGTYVGVANPVPASLLLNKDPNLGLNRDPRHLPKQEPISIIDQGEPKGTGATCGKKGSQAGAEGQPSTVKRYTPARIAPGLPGCQTKELSLWKPTGPANIYPRCSVNGKPTSTQVLPVGWSPYHQASLLSIGISSAGQLTPSQGAPIRPTSVVSEFSGVPSLSSSEAVHGLPEGQPRPGGSFVPEQDPVTKNKTCRIAAKPYEEQVNPVLLTLSPQTGTLALSVQPSGGDIRMNQGPEESESHLCSDSTPKMEGPQGACGLKLAGDTKPKNQVLATYMSHELVLATPQNLPKMPELPLLPHDSHPKELILDVVPSSRRGSSTERPQLGSQVDLGRVKMEKVDGDVVFNLATCFRADGLPVAPQRGQAEVRAKAGQARVKQESVGVFACKNKWQPDDVTESLPPKKMKCGKEKDSEEQQLQPQAKAVVRSSHRPKCRKLPSDPQESTKKSPRGASDSGKEHNGVRGKHKHRKPTKPESQSPGKRADSHEEGSLEKKAKSSFRDFIPVVLSTRTRSQSDLKARKQKTSSSQSLEHRLRNRNLLLPNKVQGISDSPNGFLPNNLEEPACLENSEKPSGKRKCKTKHMATVSEEAK

SEQ ID NO: 8877 - protein, 1711 aa, Homo sapiens; identical to SEQ ID NO: 8874
  Payload ID: 1799;
  Gene Symbol: BCORL1;
  Gene Name: BCL6 corepressor-like 1;
  Uniprot ID:  Q5H9F3;
  ENSP ID: ENSP00000437775

SEQ ID NO: 8878 - protein, 45 aa, Homo sapiens
  Payload ID: 1799;
  Gene Symbol: BCORL1;
  Gene Name: BCL6 corepressor-like 1;
  ENSP ID: ENSP00000476643
MISTAPLYSGVHNWTSSDRIRMCGINEESHFQQWSPPTSASPTAF

SEQ ID NO: 8879 - protein, 28 aa, Homo sapiens
  Payload ID: 1799;
  Gene Symbol: BCORL1;
  Gene Name: BCL6 corepressor-like 1;
  ENSP ID: ENSP00000484149
MISTAPLYSGVHNWTSSDRIRMCGINEE

SEQ ID NO: 8880 - protein, 540 aa, Homo sapiens
  Payload ID: 1800;
  Gene Symbol: BFSP1;
  Gene Name: beaded filament structural prt 1, filensin;
  Uniprot ID:  Q12934;
  ENSP ID: ENSP00000367099
MYENECECQLLLKEMLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAPLKGLEDTKLVQVVLKEESESKFESESKEVSPLTQEGAPEDVPDGGQISKGFGKLYRKVKEKVRSPKEPETPTELYTKERHVLVTGDANYVDPRFYVSSITAKGGVAVSVAEDSVLYDGQVEPSPESPKPPLENGQVGLQEKEDGQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 8881 - protein, 665 aa, Homo sapiens
  Payload ID: 1800;
  Gene Symbol: BFSP1;
  Gene Name: beaded filament structural prt 1, filensin;
  Uniprot ID:  Q12934;
  ENSP ID: ENSP00000367104
MYRRSYVFQTRKEQYEHADEASRAAEPERPADEGWAGATSLAALQGLGERVAAHVQRARALEQRHAGLRRQLDAFQRLGELAGPEDALARQVESNRQRVRDLEAERARLERQGTEAQRALDEFRSKYENECECQLLLKEMLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAPLKGLEDTKLVQVVLKEESESKFESESKEVSPLTQEGAPEDVPDGGQISKGFGKLYRKVKEKVRSPKEPETPTELYTKERHVLVTGDANYVDPRFYVSSITAKGGVAVSVAEDSVLYDGQVEPSPESPKPPLENGQVGLQEKEDGQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 8882 - protein, 526 aa, Homo sapiens
  Payload ID: 1800;
  Gene Symbol: BFSP1;
  Gene Name: beaded filament structural prt 1, filensin;
  Uniprot ID:  Q12934;
  ENSP ID: ENSP00000442522
MLERLNKEADEALLHNLRLQLEAQFLQDDISAAKDRHKKNLLEVQTYISILQQIIHTTPPASIVTSGMREEKLLTEREVAALRSQLEEGREVLSHLQAQRVELQAQTTTLEQAIKSAHECYDDEIQLYNEQIETLRKEIEETERVLEKSSYDCRQLAVAQQTLKNELDRYHRIIEIEGNRLTSAFIETPIPLFTQSHGVSLSTGSGGKDLTRALQDITAAKPRQKALPKNVPRRKEIITKDKTNGALEDAPLKGLEDTKLVQVVLKEESESKFESESKEVSPLTQEGAPEDVPDGGQISKGFGKLYRKVKEKVRSPKEPETPTELYTKERHVLVTGDANYVDPRFYVSSITAKGGVAVSVAEDSVLYDGQVEPSPESPKPPLENGQVGLQEKEDGQPIDQQPIDKEIEPDGAELEGPEEKREGEERDEESRRPCAMVTPGAEEPSIPEPPKPAADQDGAEVLGTRSRSLPEKGPPKALAYKTVEVVESIEKISTESIQTYEETAVIVETMIGKTKSDKKKSGEKSS

SEQ ID NO: 8883 - protein, 415 aa, Homo sapiens
  Payload ID: 1801;
  Gene Symbol: BFSP2;
  Gene Name: beaded filament structural prt 2, phakinin;
  Uniprot ID:  Q13515;
  ENSP ID: ENSP00000304987
MSERRVVVDLPTSASSSMPLQRRRASFRGPRSSSSLESPPASRTNAMSGLVRAPGVYVGTAPSGCIGGLGARVTRRALGISSVFLQGLRSSGLATVPAPGLERDHGAVEDLGGCLVEYMAKVHALEQVSQELETQLRMHLESKATRSGNWGALRASWASSCQQVGEAVLENARLMLQTETIQAGADDFKERYENEQPFRKAAEEEINSLYKVIDEANLTKMDLESQIESLKEELGSLSRNYEEDVKLLHKQLAGCELEQMDAPIGTGLDDILETIRIQWERDVEKNRVEAGALLQAKQQAEVAHMSQTQEEKLAAALRVELHNTSCQVQSLQAETESLRALKRGLENTLHDAKHWHDMELQNLGAVVGRLEAELREIRAEAEQQQQERAHLLARKCQLQKDVASYHALLDREESG

SEQ ID NO: 8884 - protein, 450 aa, Homo sapiens
  Payload ID: 1802;
  Gene Symbol: BECN1;
  Gene Name: beclin 1, autophagy related;
  Uniprot ID:  Q14457;
  ENSP ID: ENSP00000355231
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 8885 - protein, 279 aa, Homo sapiens
  Payload ID: 1802;
  Gene Symbol: BECN1;
  Gene Name: beclin 1, autophagy related;
  ENSP ID: ENSP00000416173
MEGSKTSNNSTMQVSFVCQRCSQPLKLDTSFKILDRVTIQELTAPLLTTAQAKPGETQEEETNSGEEPFIETPRQDGVSRRFIPPARRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKDGCGERQD

SEQ ID NO: 8886 - protein, 450 aa, Homo sapiens; identical to SEQ ID NO: 8884
  Payload ID: 1802;
  Gene Symbol: BECN1;
  Gene Name: beclin 1, autophagy related;
  Uniprot ID:  Q14457;
  ENSP ID: ENSP00000465364

SEQ ID NO: 8887 - protein, 76 aa, Homo sapiens
  Payload ID: 1802;
  Gene Symbol: BECN1;
  Gene Name: beclin 1, autophagy related;
  ENSP ID: ENSP00000465658
MEGSKTSNNSTMQVSFVCQRCSQPLKLDTSFKILDRVTIQELTGQRDPWKEGGQECGSSITYHSPGETRRDPGGRD

SEQ ID NO: 8888 - protein, 55 aa, Homo sapiens
  Payload ID: 1802;
  Gene Symbol: BECN1;
  Gene Name: beclin 1, autophagy related;
  ENSP ID: ENSP00000465964
GNHSYLESLTDKSKAEVQWHDLGLLQPPPPGFKQFPCLSLLSIWDYRHAPPRPAN

SEQ ID NO: 8889 - protein, 229 aa, Homo sapiens
  Payload ID: 1802;
  Gene Symbol: BECN1;
  Gene Name: beclin 1, autophagy related;
  ENSP ID: ENSP00000466281
  MOD_RES (1)..(1): Any amino acid
XGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKDGCGERQD

SEQ ID NO: 8890 - protein, 106 aa, Homo sapiens
  Payload ID: 1802;
  Gene Symbol: BECN1;
  Gene Name: beclin 1, autophagy related;
  ENSP ID: ENSP00000466419
  MOD_RES (1)..(1): Any amino acid
XHSGQFGTINNFRLGRLPSVPVEWNEINAAWGQTVLLLHALANKMGLKFQRMDVEKGKIEDTGGSGGSYSIKTQFNSEEQWTKALKFMLTNLKWGLAWVSSQFYNK

SEQ ID NO: 8891 - protein, 176 aa, Homo sapiens
  Payload ID: 1802;
  Gene Symbol: BECN1;
  Gene Name: beclin 1, autophagy related;
  ENSP ID: ENSP00000466766
MEGSKTSNNSTMQVSFVCQRCSQPLKLDTSFKILDRVTIQELTAPLLTTAQAKPGETQEEETNSGEEPFIETPRQDGVSRRFIPPARRCLEILEQMNEDDSEQLQMELKELALEEERLIQELEDVEKNRKIVAENLEKVQAEAERLDQEEAQHSGQFGTINNFRLGRLPSVPVEWN

SEQ ID NO: 8892 - protein, 59 aa, Homo sapiens
  Payload ID: 1802;
  Gene Symbol: BECN1;
  Gene Name: beclin 1, autophagy related;
  ENSP ID: ENSP00000467937
MEGSKTSNNSTMQVSFVCQRCSQPLKLDTSFKILDRVTIQELTAPLLTTAQAKPGETQE

SEQ ID NO: 8893 - protein, 132 aa, Homo sapiens
  Payload ID: 1802;
  Gene Symbol: BECN1;
  Gene Name: beclin 1, autophagy related;
  ENSP ID: ENSP00000468104
LNVTENECQNYKRCLEILEQMNEDDSEQLQMELKELALEEERLIQELEDVEKNRKIVAENLEKVQAEAERLDQEEAQMDVEKGKIEDTGGSGGSYSIKTQFNSEEQWTKALKFMLTNLKWGLAWVSSQFYNK

SEQ ID NO: 8894 - protein, 72 aa, Homo sapiens
  Payload ID: 1802;
  Gene Symbol: BECN1;
  Gene Name: beclin 1, autophagy related;
  ENSP ID: ENSP00000468461
  MOD_RES (1)..(1): Any amino acid
XAQTQLDKLKKTNVFNATFHIWHSGQFGTINNFRLGRLPSVPVEWNEINAAWGQTVLLLHALANKMGLKFQR

SEQ ID NO: 8895 - protein, 109 aa, Homo sapiens
  Payload ID: 1802;
  Gene Symbol: BECN1;
  Gene Name: beclin 1, autophagy related;
  ENSP ID: ENSP00000468597
  MOD_RES (1)..(1): Any amino acid
XAAWGQTVLLLHALANKMGLKFQRSCRYTVLGGCGFSGTTSLTMQWWLSWTVCSSSKKRLRKARHVFVFPTGWMWRKARLKTQEAVAAPIPSKPSLTLRSSGQKLSSSC

SEQ ID NO: 8896 - protein, 20 aa, Homo sapiens
  Payload ID: 1802;
  Gene Symbol: BECN1;
  Gene Name: beclin 1, autophagy related;
  ENSP ID: ENSP00000479791
MEGSKTSNNSTMQVSFVCQR

SEQ ID NO: 8897 - protein, 431 aa, Homo sapiens
  Payload ID: 1803;
  Gene Symbol: BECN2;
  Gene Name: beclin 2;
  Uniprot ID:  A8MW95;
  ENSP ID: ENSP00000488361
MSSIRFLCQRCHQALKLSGSSESRSLPAAPAPTSGQAEPGDTREPGVTTREVTDAEEQQDGASSRSPPGDGSVSKGHANIFTLLGELGAMHMLSSIQKAAGDIFDIVSGQAVVDHPLCEECTDSLLEQLDIQLALTEADSQNYQRCLETGELATSEDEAAALRAELRDLELEEARLVQELEDVDRNNARAAADLQAAQAEAAELDQQERQHYRDYSALKRQQLELLDQLGNVENQLQYARVQRDRLKEINCFTATFEIWVEGPLGVINNFRLGRLPTVRVGWNEINTAWGQAALLLLTLANTIGLQFQRYRLIPCGNHSYLKSLTDDRTELPLFCYGGQDVFLNNKYDRAMVAFLDCMQQFKEEAEKGELGLSLPYGIQVETGLMEDVGGRGECYSIRTHLNTQELWTKALKFMLINFKWSLIWVASRYQK

SEQ ID NO: 8898 - protein, 645 aa, Homo sapiens
  Payload ID: 1804;
  Gene Symbol: BEND2;
  Gene Name: BEN domain containing 2;
  Uniprot ID:  Q8NDZ0;
  ENSP ID: ENSP00000369369
MSERTQEQDFVIITVDDSDDNNDCSIEMVEVSETADNSTNDIADDSTYVTADNPTDDTATQPNFPGGNDGHHRPLQMSYGSGSVTQAGVQWHDHSSLQPQPLGLKQFFHLSLPSSWDDRRTPPCPVAHGDQIVSQINHPVHLRRYSYNSEEVDFPKRGRFYTPEVQSSISPPAERQETHAWASPAVTSLESAACHELQEADLSESLSYPRIVSSSSLQQYVAQGGSFPCFGMPWNFISGGAESTNAVISFANATTAVPMAVLSRRESSLANNPGVVNYSALPENENVGPGRALSSFCFHPNLESGPQMSYGTMSYSTEMKNNCDQDDASASACLTPDFALLPLNILVKVDTNTENSVNTMNRSTLLDSDSGQDSSSSSVCIPPKYGYLGDPKRNVRVLKIHLLAVQNMAKPKQAACYLVRILFSKEILISSSVDIHLKDSQSLDPNKMAALREYLATTFPTCDLHEHGKDWQDCISGINSMIYCLCSEGKSTPKTVRKNKKRTNRVASASADRNDQRGRDGGEGCSWMFQPMNNSKMREKRNLQPNSNAIPEGMREPSTDNPEEPGEAWSYFGRPWRNIRMPCSVLTLAKTKSCASLSARYLIQKLFTKDVLVQSNVYGNLKHGLCALDPNKISALRGLLHIEYV

SEQ ID NO: 8899 - protein, 799 aa, Homo sapiens
  Payload ID: 1804;
  Gene Symbol: BEND2;
  Gene Name: BEN domain containing 2;
  Uniprot ID:  Q8NDZ0;
  ENSP ID: ENSP00000369372
MSERTQEQDFVIITVDDSDDNNDCSIEMVEVSETADNSTNDIADDSTYVTADNPTDDTATQPNFPGGNDGHHRPLQMSYGSGSVTQAGVQWHDHSSLQPQPLGLKQFFHLSLPSSWDDRRTPPCPVAHGDQIVSQINHPVHLRRYSYNSEEVDFPKRGRFYTPEVQSSISPPAERQETHAWASPAVTSLESAACHELQEADLSESLSYPRIVSSSSLQQYVAQGGSFPCFGMPWNFISGGAESTNAVISFANATTAVPMAVLSRRESSLANNPGVVNYSALPENENVGPGRALSSFCFHPNLEMPERPANSSKNSTETANYPTLMGNYNGQNTASLSVFIPPYFAEKIILTEMPGTTETNVENNSQTVYYPALSGNTSAPYPASSYLPITSNFESGPQMSYGTMSYSTEMKNNCDQDDASASACLTPDFALLPLNILVKVDTNTENSVNTMNRSTLLDSDSGQDSSSSSVCIPPKYGYLGDPKRNVRVLKIHLLAVQNMAKPKQAACYLVRILFSKEILISSSVDIHLKDSQSLDPNKMAALREYLATTFPTCDLHEHGKDWQDCISGINSMIYCLCSEGKSTPKTVRKNKKRTNRVASASADRNDQRGRDGGEGCSWMFQPMNNSKMREKRNLQPNSNAIPEGMREPSTDNPEEPGEAWSYFGRPWRNIRMPCSVLTLAKTKSCASLSARYLIQKLFTKDVLVQSNVYGNLKHGLCALDPNKISALREFLQENYPICDLSENGRDWKSCVTSINSGIRSLRHDVRRAEARSQSLPAVTPPELEQESKPGDPDATDPST

SEQ ID NO: 8900 - protein, 828 aa, Homo sapiens
  Payload ID: 1805;
  Gene Symbol: BEND3;
  Gene Name: BEN domain containing 3;
  Uniprot ID:  Q5T5X7;
  ENSP ID: ENSP00000358038
MNSTEFTEDVEEVLKSITVKVETEAEDAALDCSVNSRTSEKHSVDSVLTALQDSSKRKQLVSDGLLDSVPGVKRRRLIPEALLAGMRNRENSSPCQGNGEQAGRGRSLGNVWPGEEEPCNDATTPSYKKPLYGISHKIMEKKNPPSGDLLNVYELFEKANASNSPSSLRLLNEPQKRDCGSTGAGTDNDPNIYFLIQKMFYMLNTLTSNMSQLHSKVDLLSLEVSRIKKQVSPTEMVAKFQPPPEYQLTAAELKQIVDQSLSGGDLACRLLVQLFPELFSDVDFSRGCSACGFAAKRKLESLHLQLIRNYVEVYYPSVKDTAVWQAECLPQLNDFFSRFWAQREMEDSQPSGQVASFFEAEQVDPGHFLDNKDQEEALSLDRSSTIASDHVVDTQDLTEFLDEASSPGEFAVFLLHRLFPELFDHRKLGEQYSCYGDGGKQELDPQRLQIIRNYTEIYFPDMQEEEAWLQQCAQRINDELEGLGLDAGSEGDPPRDDCYDSSSLPDDISVVKVEDSFEGERPGRRSKKIWLVPIDFDKLEIPQPDFEVPGADCLLSKEQLRSIYESSLSIGNFASRLLVHLFPELFTHENLRKQYNCSGSLGKKQLDPSRIKLIRHYVQLLYPRAKNDRVWTLEFVGKLDERCRRRDTEQRRSYQQQRKVHVPGPECRDLTSYAINPERFREEFEGPPLPPERSSKDFCKIPLDELVVPSPDFPVPSPYLLSDKEVREIVQQSLSVGNFAARLLVRLFPELFTAENLRLQYNHSGACNKKQLDPTRLRLIRHYVEAVYPVEKMEEVWHYECIPSIDERCRRPNRKKCDILKKAKKVEK

SEQ ID NO: 8901 - protein, 828 aa, Homo sapiens; identical to SEQ ID NO: 8900
  Payload ID: 1805;
  Gene Symbol: BEND3;
  Gene Name: BEN domain containing 3;
  Uniprot ID:  Q5T5X7;
  ENSP ID: ENSP00000411268

SEQ ID NO: 8902 - protein, 437 aa, Homo sapiens
  Payload ID: 1806;
  Gene Symbol: BEND4;
  Gene Name: BEN domain containing 4;
  ENSP ID: ENSP00000421160
MQPAEEGPSVPKIYKQRSPYSVLKTFPSKRPALAKRYERPTLVELPHVRAPPPPPPPFAPHAAVSISSSEPPPQQFQAQSSYPPGPGRAAAAASSSSPSCTPATSQGHLRTPAQPPPASPAASSSSSFAAVVRYGPGAAAAAGTGGTGSDSASLELSAESRMILDAFAQQCSRVLSLLNCGGKLLDSNHSQSMISCVKQEGSSYNERQEHCHIGKGVHSQTSDNVDIEMQYMQRKQQTSAFLRVFTDSLQNYLLSGSFPTPNPSSASEYGHLADVDPLSTSPVHTLGGWTSPATSESHGHPSSSTLPEEEEEEDEEGYCPRCQELEQEVISLQQENEELRRKLESIPVPCQTVLDYLKMVLQHHNQLLIPQPADQPTEGSKQLLNNYPVYITSKQWDEAVNSSKKDGRRLLRYLIRFVFTTDELKYSCGLGKRKRIH

SEQ ID NO: 8903 - protein, 534 aa, Homo sapiens
  Payload ID: 1806;
  Gene Symbol: BEND4;
  Gene Name: BEN domain containing 4;
  Uniprot ID:  Q6ZU67;
  ENSP ID: ENSP00000421169
MEEEMQPAEEGPSVPKIYKQRSPYSVLKTFPSKRPALAKRYERPTLVELPHVRAPPPPPPPFAPHAAVSISSSEPPPQQFQAQSSYPPGPGRAAAAASSSSPSCTPATSQGHLRTPAQPPPASPAASSSSSFAAVVRYGPGAAAAAGTGGTGSDSASLELSAESRMILDAFAQQCSRVLSLLNCGGKLLDSNHSQSMISCVKQEGSSYNERQEHCHIGKGVHSQTSDNVDIEMQYMQRKQQTSAFLRVFTDSLQNYLLSGSFPTPNPSSASEYGHLADVDPLSTSPVHTLGGWTSPATSESHGHPSSSTLPEEEEEEDEEGYCPRCQELEQEVISLQQENEELRRKLESIPVPCQTVLDYLKMVLQHHNQLLIPQPADQPTEGSKQLLNNYPVYITSKQWDEAVNSSKKDGRRLLRYLIRFVFTTDELKYSCGLGKRKRSVQSGETGPERRPLDPVKVTCLREFIRMHCTSNPDWWMPSEEQINKVFSDAVGHARQGRAVGTFLHNGGSFYEGIDHQASQDEVFNKSSQDGSGD

SEQ ID NO: 8904 - protein, 405 aa, Homo sapiens
  Payload ID: 1806;
  Gene Symbol: BEND4;
  Gene Name: BEN domain containing 4;
  ENSP ID: ENSP00000478660
MQPAEEGPSVPKIYKQRSPYSVLKTFPSLELSAESRMILDAFAQQCSRVLSLLNCGGKLLDSNHSQSMISCVKQEGSSYNERQEHCHIGKGVHSQTSDNVDIEMQYMQRKQQTSAFLRVFTDSLQNYLLSGSFPTPNPSSASEYGHLADVDPLSTSPVHTLGGWTSPATSESHGHPSSSTLPEEEEEEDEEGYCPRCQELEQEVISLQQENEELRRKLESIPVPCQTVLDYLKMVLQHHNQLLIPQPADQPTEGSKQLLNNYPVYITSKQWDEAVNSSKKDGRRLLRYLIRFVFTTDELKYSCGLGKRKRSVQSGETGPERRPLDPVKVTCLREFIRMHCTSNPDWWMPSEEQINKVFSDAVGHARQGRAVGTFLHNGGSFYEGIDHQASQDEVFNKSSQDGSGD

SEQ ID NO: 8905 - protein, 421 aa, Homo sapiens
  Payload ID: 1807;
  Gene Symbol: BEND5;
  Gene Name: BEN domain containing 5;
  Uniprot ID:  Q7L4P6;
  ENSP ID: ENSP00000360899
MYAFVRFLEDNVCYALPVSCVRDFSPRSRLDFDNQKVYAVYRGPEELGAGPESPPRAPRDWGALLLHKAQILALAEDKSDLENSVMQKKIKIPKLSLNHVEEDGEVKDYGEEDLQLRHIKRPEGRKPSEVAHKSIEAVVARLEKQNGLSLGHSTCPEEVFVEASPGTEDMDSLEDAVVPRALYEELLRNYQQQQEEMRHLQQELERTRRQLVQQAKKLKEYGALVSEMKELRDLNRRLQDVLLLRLGSGPAIDLEKVKSECLEPEPELRSTFSEEANTSSYYPAPAPVMDKYILDNGKVHLGSGIWVDEEKWHQLQVTQGDSKYTKNLAVMIWGTDVLKNRSVTGVATKKKKDAVPKPPLSPHKLSIVRECLYDRIAQETVDETEIAQRLSKVNKYICEKIMDINKSCKNEERREAKYNLQ

SEQ ID NO: 8906 - protein, 129 aa, Homo sapiens
  Payload ID: 1808;
  Gene Symbol: BEND6;
  Gene Name: BEN domain containing 6;
  ENSP ID: ENSP00000359781
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQGNKLDITTEKTILHGGMKTLNVVTTSSHPV

SEQ ID NO: 8907 - protein, 279 aa, Homo sapiens
  Payload ID: 1808;
  Gene Symbol: BEND6;
  Gene Name: BEN domain containing 6;
  Uniprot ID:  Q5SZJ8;
  ENSP ID: ENSP00000359782
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQVLPQAVTQFEELVGMAEALLKGGGTMSTSASTLWRATNNSSPDSFASTCSNSNSNSSSPVSLKPEEEHQTDEKQFQIEKWQIARCNKSKPQKFINDLMQVLYTNEYMATHSLTGAKSSTSRDKAVKPAMNQNEVQEIIGVTKQLFPNTDDVSIRRMIGQKLNNCTKKPNLSKNLNSQDIK

SEQ ID NO: 8908 - protein, 106 aa, Homo sapiens
  Payload ID: 1808;
  Gene Symbol: BEND6;
  Gene Name: BEN domain containing 6;
  Uniprot ID:  Q5SZJ8;
  ENSP ID: ENSP00000359784
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQAWSRELP

SEQ ID NO: 8909 - protein, 468 aa, Homo sapiens
  Payload ID: 1809;
  Gene Symbol: BEND7;
  Gene Name: BEN domain containing 7;
  Uniprot ID:  Q8N7W2;
  ENSP ID: ENSP00000345773
MEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSAEIADSDERLDGIALPPTGACGGPCTVLPGGSAAVTLVLQSSPQTMSQEKGQMAEPWEEQHLVLLNNLTRDRAETGALSQTSQDFKHHSFLITQVSATLHHQRGIRNFPTPGSAKSLTLHISCLSL

SEQ ID NO: 8910 - protein, 374 aa, Homo sapiens
  Payload ID: 1809;
  Gene Symbol: BEND7;
  Gene Name: BEN domain containing 7;
  Uniprot ID:  Q8N7W2;
  ENSP ID: ENSP00000367868
MEIKKQITGMRRLLNDSTGRIYQRVGKEGEKLKEEPQDLDLVWPPRLNSSAEAPQSLHPSSRGVWNELPPQSGQFSGQYGTRSRTFQSQPHPTTSSNGMVVNKHSEGSHGGELPVVNSSAGSNCCTCNCQSTLQAILQELKTMRKLMQIQAVGTQNRQQPPISLICSQRTAVSRKRNKKKKVPPKTVEPLTVKQKPSGSEMEKKSVVASELSALQAAEHTSPEESRVLGFGIVLESPSSDPEVQLAEGFDVFMPKSQLDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTVV

SEQ ID NO: 8911 - protein, 117 aa, Homo sapiens
  Payload ID: 1809;
  Gene Symbol: BEND7;
  Gene Name: BEN domain containing 7;
  ENSP ID: ENSP00000401256
LDSILSNYTRSGSLLFRKLVCAFFDDKTLANSLPNGKRKRGLNDNRKGLDQNIVGAIKVFTEKYCTANHVDKLPGPRDWVQILQDQIKLARRRLKRGSEIADSDERLDGIALPPTGK

SEQ ID NO: 8912 - protein, 1797 aa, Homo sapiens
  Payload ID: 1810;
  Gene Symbol: BZRAP1;
  Gene Name: benzodiazepine receptor (peripheral) associated prt 1;
  Uniprot ID:  O95153;
  ENSP ID: ENSP00000268893
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQRTRRRRVQC

SEQ ID NO: 8913 - protein, 1857 aa, Homo sapiens
  Payload ID: 1810;
  Gene Symbol: BZRAP1;
  Gene Name: benzodiazepine receptor (peripheral) associated prt 1;
  Uniprot ID:  O95153;
  ENSP ID: ENSP00000345824
MEQLTTLPRPGDPGAMEPWALPTWHSWTPGRGGEPSSAAPSIADTPPAALQLQELRSEESSKPKGDGSSRPVGGTDPEGAEACLPSLGQQASSSGPACQRPEDEEVEAFLKAKLNMSFGDRPNLELLRALGELRQRCAILKEENQMLRKSSFPETEEKVRRLKRKNAELAVIAKRLEERARKLQETNLRVVSAPLPRPGTSLELCRKALARQRARDLSETASALLAKDKQIAALQRECRELQARLTLVGKEGPQWLHVRDFDRLLRESQREVLRLQRQIALRNQRETLPLPPSWPPGPALQARAGAPAPGAPGEATPQEDADNLPVILGEPEKEQRVQQLESELSKKRKKCESLEQEARKKQRRCEELELQLRQAQNENARLVEENSRLSGRATEKEQVEWENAELRGQLLGVTQERDSALRKSQGLQSKLESLEQVLKHMREVAQRRQQLEVEHEQARLSLREKQEEVRRLQQAQAEAQREHEGAVQLLESTLDSMQARVRELEEQCRSQTEQFSLLAQELQAFRLHPGPLDLLTSALDCGSLGDCPPPPCCCSIPQPCRGSGPKDLDLPPGSPGRCTPKSSEPAPATLTGVPRRTAKKAESLSNSSHSESIHNSPKSCPTPEVDTASEVEELEADSVSLLPAAPEGSRGGARIQVFLARYSYNPFEGPNENPEAELPLTAGEYIYIYGNMDEDGFFEGELMDGRRGLVPSNFVERVSDDDLLTSLPPELADLSHSSGPELSFLSVGGGGSSSGGQSSVGRSQPRPEEEDAGDELSLSPSPEGLGEPPAVPYPRRLVVLKQLAHSVVLAWEPPPEQVELHGFHICVNGELRQALGPGAPPKAVLENLDLWAGPLHISVQALTSRGSSDPLRCCLAVGARAGVVPSQLRVHRLTATSAEITWVPGNSNLAHAIYLNGEECPPASPSTYWATFCHLRPGTPYQAQVEAQLPPQGPWEPGWERLEQRAATLQFTTLPAGPPDAPLDVQIEPGPSPGILIISWLPVTIDAAGTSNGVRVTGYAIYADGQKIMEVASPTAGSVLVELSQLQLLQVCREVVVRTMSPHGESADSIPAPITPALAPASLPARVSCPSPHPSPEARAPLASASPGPGDPSSPLQHPAPLGTQEPPGAPPASPSREMAKGSHEDPPAPCSQEEAGAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKSQPDPFCETDSDEEILEQILELPLQQFCSKKLFSIPEEEEEEEEDEEEEKSGAGCSSRDPGPPEPALLGLGCDSGQPRRPGQCPLSPESSRAGDCLEDMPGLVGGSSRRRGGGSPEKPPSRRRPPDPREHCSRLLSNNGPQASGRLGPTRERGGLPVIEGPRTGLEASGRGRLGPSRRCSRGRALEPGLASCLSPKCLEISIEYDSEDEQEAGSGGISITSSCYPGDGEAWGTATVGRPRGPPKANSGPKPYPRLPAWEKGEPERRGRSATGRAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSGNGPFVYSTAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQRTRRRRVQC

SEQ ID NO: 8914 - protein, 171 aa, Homo sapiens
  Payload ID: 1810;
  Gene Symbol: BZRAP1;
  Gene Name: benzodiazepine receptor (peripheral) associated prt 1;
  ENSP ID: ENSP00000462518
RRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQDWGCTTQGSPGPPGGPCTPSSGSAPRIERGEPQGRSEKVWGFFSKGKQLLRRLGSGKKE

SEQ ID NO: 8915 - protein, 296 aa, Homo sapiens
  Payload ID: 1810;
  Gene Symbol: BZRAP1;
  Gene Name: benzodiazepine receptor (peripheral) associated prt 1;
  ENSP ID: ENSP00000462710
  MOD_RES (1)..(1): Any amino acid
XAAVLGTSEERTASTSTLGEKDPGPAAPSLAKQEAEWTAGEACPASSSTQGARAQQAPNTEMCQGGDPGSGLRPRAEKEDTAELGVHLVNSLVDHGRNSDLSDIQEEEEEEEEEEEEELGSRTCSFQKQVAGNSIRENGAKATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSAHTTGPPPKPRRSKK

SEQ ID NO: 8916 - protein, 270 aa, Homo sapiens
  Payload ID: 1810;
  Gene Symbol: BZRAP1;
  Gene Name: benzodiazepine receptor (peripheral) associated prt 1;
  ENSP ID: ENSP00000462822
  MOD_RES (1)..(1): Any amino acid
XAKEPLSRATETGEARGQDGSGRRGPQKRGVRVLRPSTAELVPARSPSETLAYQHLPVRIFVALFDYDPVSMSPNPDAGEEELPFREGQILKVFGDKDADGFYQGEGGGRTGYIPCNMVAEVAVDSPAGRQQLLQRGYLSPDILLEGSAHTTGPPPKPRRSKKAESEGPAQPCPGPPKLVPSADLKAPHSMVAAFDYNPQESSPNMDVEAELPFRAGDVITVFGGMDDDGFYYGELNGQRGLVPSNFLEGPGPEAGGLDREPRTPQAESQ

SEQ ID NO: 8917 - protein, 287 aa, Homo sapiens
  Payload ID: 1811;
  Gene Symbol: BSCL2;
  Gene Name: Berardinelli-Seip congenital lipodystrophy 2 (seipin);
  Uniprot ID:  Q96G97;
  ENSP ID: ENSP00000278893
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRLTSEKETIPGRKSNEGSLLISQGLKARRSQLRNQMLQRMVRALKIPQGQRVSCPRRRNQISSP

SEQ ID NO: 8918 - protein, 277 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000301781
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVTSCYLALQSRSSCWRWNSTQTIERTRTCRPLERSLRSTASASSCMEPTSASTRTSLGSDTCYTTSR

SEQ ID NO: 8919 - protein, 462 aa, Homo sapiens
  Payload ID: 1811;
  Gene Symbol: BSCL2;
  Gene Name: Berardinelli-Seip congenital lipodystrophy 2 (seipin);
  Uniprot ID:  Q96G97;
  ENSP ID: ENSP00000354032
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 8920 - protein, 398 aa, Homo sapiens
  Payload ID: 1811;
  Gene Symbol: BSCL2;
  Gene Name: Berardinelli-Seip congenital lipodystrophy 2 (seipin);
  Uniprot ID:  Q96G97;
  ENSP ID: ENSP00000384080
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 8921 - protein, 79 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000384258
VFSSLLLFGFAEQKQLLEVELYADYRENSYVPTTGAIIEIHSKRIQLYGAYLRIHAHFTGLSSEPAGGALRQRPTCSSS

SEQ ID NO: 8922 - protein, 464 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000385332
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGAGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 8923 - protein, 398 aa, Homo sapiens; identical to SEQ ID NO: 8920
  Payload ID: 1811;
  Gene Symbol: BSCL2;
  Gene Name: Berardinelli-Seip congenital lipodystrophy 2 (seipin);
  Uniprot ID:  Q96G97;
  ENSP ID: ENSP00000385561

SEQ ID NO: 8924 - protein, 39 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000393728
MSTEKVDQKEEAGEKEVCGDQIKGPDKEEMPTGPRSCGR

SEQ ID NO: 8925 - protein, 150 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000405265
FSYMQWVWGGIWPRHRFSLQVNIRKRDNSRKEVQRRISAHQPGPEGQEESTPQSDVTEDVSGSDPCIPLLAAEGQLSEEEKPDQQPLSGEEELEPEASDGSGSWEDAALLTEANLPAPAPASASAPVLETLGSSEPAGGALRQRPTCSSS

SEQ ID NO: 8926 - protein, 398 aa, Homo sapiens; identical to SEQ ID NO: 8920
  Payload ID: 1811;
  Gene Symbol: BSCL2;
  Gene Name: Berardinelli-Seip congenital lipodystrophy 2 (seipin);
  Uniprot ID:  Q96G97;
  ENSP ID: ENSP00000413209

SEQ ID NO: 8927 - protein, 223 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000413340
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGL

SEQ ID NO: 8928 - protein, 93 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000431782
MSTEKVDQKEEAGEKEVCGDQIKGPDKEEEPPAAASHGQGWRPGGRAARNARPEPGARHPALPAMVNDPPVPALLWAQEVGQVLAGRARRLLL

SEQ ID NO: 8929 - protein, 226 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000433888
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTL

SEQ ID NO: 8930 - protein, 99 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000434149
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRV

SEQ ID NO: 8931 - protein, 28 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000435500
MSTEKVDQKEEAGEKEVCGDQIKGPDKE

SEQ ID NO: 8932 - protein, 123 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000435831
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPT

SEQ ID NO: 8933 - protein, 111 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000436026
MSTEKVDQKEEAGEKEVCGDQIKGPDKEEVLMYGQPYRVTLELELPESPVNQDLGMFLVTISCYTRGGRIISTSSRSVMLHYRSDLLQMLDTLVFSSLLLFGFAEQKQLLE

SEQ ID NO: 8934 - protein, 23 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000436991
MSTEKVDQKEEAGEKEVCGDQIK

SEQ ID NO: 8935 - protein, 52 aa, Homo sapiens
  Payload ID: 1811;
  Gene Symbol: BSCL2;
  Gene Name: Berardinelli-Seip congenital lipodystrophy 2 (seipin);
  ENSP ID: ENSP00000437044
  MOD_RES (1)..(1): Any amino acid
XAETRSKDRTKRRTDCDSSTTSLCSFPVANVSLTKGGRDRVLMYGQPYRVTL

SEQ ID NO: 8936 - protein, 585 aa, Homo sapiens
  Payload ID: 1812;
  Gene Symbol: BEST1;
  Gene Name: bestrophin 1;
  Uniprot ID:  O76090;
  ENSP ID: ENSP00000367282
MTITYTSQVANARLGSFSRLLLCWRGSIYKLLYGEFLIFLLCYYIIRFIYRLALTEEQQLMFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVAEQLINPFGEDDDDFETNWIVDRNLQVSLLAVDEMHQDLPRMEPDMYWNKPEPQPPYTAASAQFRRASFMGSTFNISLNKEEMEFQPNQEDEEDAHAGIIGRFLGLQSHDHHPPRANSRTKLLWPKRESLLHEGLPKNHKAAKQNVRGQEDNKAWKLKAVDAFKSAPLYQRPGYYSAPQTPLSPTPMFFPLEPSAPSKLHSVTGIDTKDKSLKTVSSGAKKSFELLSESDGALMEHPEVSQVRRKTVEFNLTDMPEIPENHLKEPLEQSPTNIHTTLKDHMDPYWALENRDEAHS

SEQ ID NO: 8937 - protein, 604 aa, Homo sapiens
  Payload ID: 1812;
  Gene Symbol: BEST1;
  Gene Name: bestrophin 1;
  Uniprot ID:  O76090;
  ENSP ID: ENSP00000399709
MFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVAEQLINPFGEDDDDFETNWIVDRNLQVSLLAVDEMHQDLPRMEPDMYWNKPEPQPPYTAASAQFRRASFMGSTFNISLNKEEMEFQPNQEDEEDAHAGIIGRFLGLQSHDHHPPRANSRTKLLWPKRESLLHEGLPKNHKAAKQNVRGQEDNKAWKLKAVDAFKSAPLYQRPGYYSAPQTPLSPTPMFFPLEPSAPSKLHSVTGIDTKDKSLKTVSSGAKKSFELLSESDGALMEHPEVSQVRRKTVEFNLTDMPEIPENHLKEPLEQSPTNIHTTLKDHMDPYWALENRSVLHLNQGHCIALCPTPASLALSLPFLHNFLGFHHCQSTLDLRPALAWGIYLATFTGILGKCSGPFLTSPWYHPEDFLGPGEGR

SEQ ID NO: 8938 - protein, 55 aa, Homo sapiens
  Payload ID: 1812;
  Gene Symbol: BEST1;
  Gene Name: bestrophin 1;
  ENSP ID: ENSP00000431189
MSLVSGFVEGKDEQGRLLRRTLIRYANLGNVLILRSVSTAVYKRFPSAQHLVQAA

SEQ ID NO: 8939 - protein, 435 aa, Homo sapiens
  Payload ID: 1812;
  Gene Symbol: BEST1;
  Gene Name: bestrophin 1;
  ENSP ID: ENSP00000432681
MTITYTSQVANARLGSFSRLLLCWRGSIYKLLYGEFLIFLLCYYIIRFIYRLALTEEQQLMFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVGLSRALLGWRHGQRGHGQQLPETRMQCQERKVSRVESSQAWWRTPVIPATREAEAGESLEPGRRRLWWQSSSSTPLERMMMILRPTGLSTGICRCPCWLWMRCTRTCLGWSRTCTGISPSHSPPTQLLPPSSVEPPLWAPPSTSA

SEQ ID NO: 8940 - protein, 329 aa, Homo sapiens
  Payload ID: 1812;
  Gene Symbol: BEST1;
  Gene Name: bestrophin 1;
  ENSP ID: ENSP00000433195
MSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVGLSRALLGWRHGQRGHGQQLPETRMQCQERKVSRVESSQAWWRTPVIPATREAEAGESLEPGRRRLWWQSSSSTPLERMMMILRPTGLSTGICRCPCWLWMRCTRTCLGWSRTCTGISPSHSPPTQLLPPSSVEPPLWAPPSTSA

SEQ ID NO: 8941 - protein, 509 aa, Homo sapiens
  Payload ID: 1813;
  Gene Symbol: BEST2;
  Gene Name: bestrophin 2;
  Uniprot ID:  Q8NFU1;
  ENSP ID: ENSP00000042931
MTVTYTARVANARFGGFSQLLLLWRGSIYKLLWRELLCFLGFYMALSAAYRFVLTEGQKRYFEKLVIYCDQYASLIPVSFVLGFYVTLVVNRWWSQYLCMPLPDALMCVVAGTVHGRDDRGRLYRRTLMRYAGLSAVLILRSVSTAVFKRFPTIDHVVEAGFMTREERKKFENLNSSYNKYWVPCVWFSNLAAQARREGRIRDNSALKLLLEELNVFRGKCGMLFHYDWISVPLVYTQVVTIALYSYFLACLIGRQFLDPAQGYKDHDLDLCVPIFTLLQFFFYAGWLKVAEQLINPFGEDDDDFETNFLIDRNFQVSMLAVDEMYDDLAVLEKDLYWDAAEARAPYTAATVFQLRQPSFQGSTFDITLAKEDMQFQRLDGLDGPMGEAPGDFLQRLLPAGAGMVAGGPLGRRLSFLLRKNSCVSEASTGASCSCAVVPEGAAPECSCGDPLLDPGLPEPEAPPPAGPEPLTLIPGPVEPFSIVTMPGPRGPAPPWLPSPIGEEEENLA

SEQ ID NO: 8942 - protein, 509 aa, Homo sapiens; identical to SEQ ID NO: 8941
  Payload ID: 1813;
  Gene Symbol: BEST2;
  Gene Name: bestrophin 2;
  Uniprot ID:  Q8NFU1;
  ENSP ID: ENSP00000447203

SEQ ID NO: 8943 - protein, 509 aa, Homo sapiens; identical to SEQ ID NO: 8941
  Payload ID: 1813;
  Gene Symbol: BEST2;
  Gene Name: bestrophin 2;
  Uniprot ID:  Q8NFU1;
  ENSP ID: ENSP00000448310

SEQ ID NO: 8944 - protein, 78 aa, Homo sapiens
  Payload ID: 1813;
  Gene Symbol: BEST2;
  Gene Name: bestrophin 2;
  ENSP ID: ENSP00000449403
  MOD_RES (1)..(1): Any amino acid
XEQLINPFGEDDDDFETNFLIDRNFQVSMLAVDEMYDDLAVLEKDLYWDAAEARAPYTAATVFQLRQPSFQGSTFDIT

SEQ ID NO: 8945 - protein, 72 aa, Homo sapiens
  Payload ID: 1814;
  Gene Symbol: BEST3;
  Gene Name: bestrophin 3;
  Uniprot ID:  Q8N1M1;
  ENSP ID: ENSP00000266661
MFLISSSVHGSDEHGRLLRRTLMRYVNLTSLLIFRSVSTAVYKRFPTMDHVVEAERTGMKPILPSSFEMQSF

SEQ ID NO: 8946 - protein, 398 aa, Homo sapiens
  Payload ID: 1814;
  Gene Symbol: BEST3;
  Gene Name: bestrophin 3;
  Uniprot ID:  Q8N1M1;
  ENSP ID: ENSP00000329064
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGKQMPKNEWKMEDIKIPLPQPQFQCAKSDPGG

SEQ ID NO: 8947 - protein, 668 aa, Homo sapiens
  Payload ID: 1814;
  Gene Symbol: BEST3;
  Gene Name: bestrophin 3;
  Uniprot ID:  Q8N1M1;
  ENSP ID: ENSP00000332413
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 8948 - protein, 455 aa, Homo sapiens
  Payload ID: 1814;
  Gene Symbol: BEST3;
  Gene Name: bestrophin 3;
  Uniprot ID:  Q8N1M1;
  ENSP ID: ENSP00000433213
MTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 8949 - protein, 197 aa, Homo sapiens
  Payload ID: 1814;
  Gene Symbol: BEST3;
  Gene Name: bestrophin 3;
  ENSP ID: ENSP00000434713
MTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVSLLAVDEMHMSLPKMKKDIYWDDSAARPPYTLAAADYCIPSFLGSTVQMGRSRFNPVPFAECLLIPISDGLWHFSSKGASEAENLSRPKEKED

SEQ ID NO: 8950 - protein, 142 aa, Homo sapiens
  Payload ID: 1814;
  Gene Symbol: BEST3;
  Gene Name: bestrophin 3;
  ENSP ID: ENSP00000446575
MTVTYSSKVANATFFGFHRLLLKWRGSIYKLLYREFIVFAVLYTAISLVYRLLLTGVQKRYFEKLSIYCDRYAEQIPVTFVLGFMTTDERKLFNHLKSPHLKYWVPFIWFGNLATKARNEGRIRDSVDLQSLMTEMNRYRSW

SEQ ID NO: 8951 - protein, 161 aa, Homo sapiens
  Payload ID: 1814;
  Gene Symbol: BEST3;
  Gene Name: bestrophin 3;
  ENSP ID: ENSP00000447689
MFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVS

SEQ ID NO: 8952 - protein, 72 aa, Homo sapiens; identical to SEQ ID NO: 8945
  Payload ID: 1814;
  Gene Symbol: BEST3;
  Gene Name: bestrophin 3;
  Uniprot ID:  Q8N1M1;
  ENSP ID: ENSP00000449377

SEQ ID NO: 8953 - protein, 562 aa, Homo sapiens
  Payload ID: 1814;
  Gene Symbol: BEST3;
  Gene Name: bestrophin 3;
  Uniprot ID:  Q8N1M1;
  ENSP ID: ENSP00000449548
MFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 8954 - protein, 143 aa, Homo sapiens
  Payload ID: 1814;
  Gene Symbol: BEST3;
  Gene Name: bestrophin 3;
  ENSP ID: ENSP00000449868
MRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQLWTKCT

SEQ ID NO: 8955 - protein, 473 aa, Homo sapiens
  Payload ID: 1815;
  Gene Symbol: BEST4;
  Gene Name: bestrophin 4;
  Uniprot ID:  Q8NFU0;
  ENSP ID: ENSP00000361281
MTVSYTLKVAEARFGGFSGLLLRWRGSIYKLLYKEFLLFGALYAVLSITYRLLLTQEQRYVYAQVARYCNRSADLIPLSFVLGFYVTLVVNRWWSQYTSIPLPDQLMCVISASVHGVDQRGRLLRRTLIRYANLASVLVLRSVSTRVLKRFPTMEHVVDAGFMSQEERKKFESLKSDFNKYWVPCVWFTNLAAQARRDGRIRDDIALCLLLEELNKYRAKCSMLFHYDWISIPLVYTQVVTIAVYSFFALSLVGRQFVEPEAGAAKPQKLLKPGQEPAPALGDPDMYVPLTTLLQFFFYAGWLKVAEQIINPFGEDDDDFETNQLIDRNLQVSLLSVDEMYQNLPPAEKDQYWDEDQPQPPYTVATAAESLRPSFLGSTFNLRMSDDPEQSLQVEASPGSGRPAPAAQTPLLGRFLGVGAPSPAISLRNFGRVRGTPRPPHLLRFRAEEGGDPEAAARIEEESAESGDEALEP

SEQ ID NO: 8956 - protein, 118 aa, Homo sapiens
  Payload ID: 1816;
  Gene Symbol: BET1;
  Gene Name: Bet1 golgi vesicular membrane trafficking prt;
  Uniprot ID:  O15155;
  ENSP ID: ENSP00000222547
MRRAGLGEGVPPGNYGNYGYANSGYSACEEENERLTESLRSKVTAIKSLSIEIGHEVKTQNKLLAEMDSQFDSTTGFLGKTMGKLKILSRGSQTKLLCYMMLFSLFVFFIIYWIIKLR

SEQ ID NO: 8957 - protein, 127 aa, Homo sapiens
  Payload ID: 1816;
  Gene Symbol: BET1;
  Gene Name: Bet1 golgi vesicular membrane trafficking prt;
  ENSP ID: ENSP00000350125
MRRAGLGEGVPPGNYGNYGYANSGYSACEEENERLTESLRSKVTAIKSLSIEIGHEVKTQNKLLAEMDSQFDSTTGFLVDPSGSRDFTSSSESLLLLILTVPQHLSRSLKRRRLTFSAIYHSCRIIS

SEQ ID NO: 8958 - protein, 83 aa, Homo sapiens
  Payload ID: 1816;
  Gene Symbol: BET1;
  Gene Name: Bet1 golgi vesicular membrane trafficking prt;
  Uniprot ID:  O15155;
  ENSP ID: ENSP00000391228
MRRAGLGEGVPPGNYGNYGYANSGYSACEEENERLTESLRSKVTAIKSLSIEIGHEVKTQNKLLAEMDSQFDSTTGFLGLCPM

SEQ ID NO: 8959 - protein, 133 aa, Homo sapiens
  Payload ID: 1816;
  Gene Symbol: BET1;
  Gene Name: Bet1 golgi vesicular membrane trafficking prt;
  ENSP ID: ENSP00000401260
  MOD_RES (1)..(1): Any amino acid
XLPSFCINHFSLPLHSHAFSMGEGVPPGNYGNYGYANSGYSACEEENERLTESLRSKVTAIKSLSIEIGHEVKTQNKLLAEMDSQFDSTTGFLGKTMGKLKILSRGSQTKLLCYMMLFSLFVFFIIYWIIKLR

SEQ ID NO: 8960 - protein, 98 aa, Homo sapiens
  Payload ID: 1816;
  Gene Symbol: BET1;
  Gene Name: Bet1 golgi vesicular membrane trafficking prt;
  ENSP ID: ENSP00000413063
MRRAGLGEGVPPGNYGNYGYANSGYSACEEENERLTESLRSKVTAIKSLSIEIGHEVKTQNKLLAEMVSGYDFNFKKFDLIFANNRISTFIHFEIQRS

SEQ ID NO: 8961 - protein, 58 aa, Homo sapiens
  Payload ID: 1817;
  Gene Symbol: BET1L;
  Gene Name: Bet1 golgi vesicular membrane trafficking prt-like;
  ENSP ID: ENSP00000333470
MADWARAQSPGAVEEILDRENKRMADSLASKVTRLKSLALDIDRDAEDQNRYLDGMGA

SEQ ID NO: 8962 - protein, 102 aa, Homo sapiens
  Payload ID: 1817;
  Gene Symbol: BET1L;
  Gene Name: Bet1 golgi vesicular membrane trafficking prt-like;
  ENSP ID: ENSP00000339093
MADWARAQSPGAVEEILDRENKRMADSLASKVTRLKSLALDIDRDAEDQNRYLDGMVRAHGVRVSVPCPSTTCCRACSVSFSTGAGGWSNHHFCVILLGFLP

SEQ ID NO: 8963 - protein, 111 aa, Homo sapiens
  Payload ID: 1817;
  Gene Symbol: BET1L;
  Gene Name: Bet1 golgi vesicular membrane trafficking prt-like;
  Uniprot ID:  Q9NYM9;
  ENSP ID: ENSP00000372210
MADWARAQSPGAVEEILDRENKRMADSLASKVTRLKSLALDIDRDAEDQNRYLDGMDSDFTSMTSLLTGSVKRFSTMARSGQDNRKLLCGMAVGLIVAFFILSYFLSRART

SEQ ID NO: 8964 - protein, 152 aa, Homo sapiens
  Payload ID: 1817;
  Gene Symbol: BET1L;
  Gene Name: Bet1 golgi vesicular membrane trafficking prt-like;
  ENSP ID: ENSP00000386558
MADWARAQSPGAVEEILDRENKRMADSLASKVTRLKSLALDIDRDAEDQNRYLDGMVFQDSQEGAHIRRETVSKSVCAEPWRHQRARDPAPTNFPLKCQKQRGASTSSGQHGGRVNLVFFIDDDYSPPSKRQRPTSHHSHQSQNPPMLGNGK

SEQ ID NO: 8965 - protein, 88 aa, Homo sapiens
  Payload ID: 1817;
  Gene Symbol: BET1L;
  Gene Name: Bet1 golgi vesicular membrane trafficking prt-like;
  ENSP ID: ENSP00000436205
MADSLASKVTRLKSLALDIDRDAEDQNRYLDGMDSDFTSMTSLLTGSVKRFSTMARSGQDNRKLLCGMAVGLIVAFFILSYFLSRART

SEQ ID NO: 8966 - protein, 92 aa, Homo sapiens
  Payload ID: 1817;
  Gene Symbol: BET1L;
  Gene Name: Bet1 golgi vesicular membrane trafficking prt-like;
  ENSP ID: ENSP00000436643
MADWARAQSPGAVEEILDRENKRMADSLASKVTRLKSDSDFTSMTSLLTGSVKRFSTMARSGQDNRKLLCGMAVGLIVAFFILSYFLSRART

SEQ ID NO: 8967 - protein, 498 aa, Homo sapiens
  Payload ID: 1818;
  Gene Symbol: B3GLCT;
  Gene Name: beta 3-glucosyltransferase;
  Uniprot ID:  Q6Y288;
  ENSP ID: ENSP00000343002
MRPPACWWLLAPPALLALLTCSLAFGLASEDTKKEVKQSQDLEKSGISRKNDIDLKGIVFVIQSQSNSFHAKRAEQLKKSILKQAADLTQELPSVLLLHQLAKQEGAWTILPLLPHFSVTYSRNSSWIFFCEEETRIQIPKLLETLRRYDPSKEWFLGKALHDEEATIIHHYAFSENPTVFKYPDFAAGWALSIPLVNKLTKRLKSESLKSDFTIDLKHEIALYIWDKGGGPPLTPVPEFCTNDVDFYCATTFHSFLPLCRKPVKKKDIFVAVKTCKKFHGDRIPIVKQTWESQASLIEYYSDYTENSIPTVDLGIPNTDRGHCGKTFAILERFLNRSQDKTAWLVIVDDDTLISISRLQHLLSCYDSGEPVFLGERYGYGLGTGGYSYITGGGGMVFSREAVRRLLASKCRCYSNDAPDDMVLGMCFSGLGIPVTHSPLFHQARPVDYPKDYLSHQVPISFHKHWNIDPVKVYFTWLAPSDEDKARQETQKGFREEL

SEQ ID NO: 8968 - protein, 334 aa, Homo sapiens
  Payload ID: 1819;
  Gene Symbol: B3GAT1;
  Gene Name: beta-1,3-glucuronyltransferase 1;
  Uniprot ID:  Q9P2W7;
  ENSP ID: ENSP00000307875
MPKRRDILAIVLIVLPWTLLITVWHQSTLAPLLAVHKDEGSDPRRETPPGADPREYCTSDRDIVEVVRTEYVYTRPPPWSDTLPTIHVVTPTYSRPVQKAELTRMANTLLHVPNLHWLVVEDAPRRTPLTARLLRDTGLNYTHLHVETPRNYKLRGDARDPRIPRGTMQRNLALRWLRETFPRNSSQPGVVYFADDDNTYSLELFEEMRSTRRVSVWPVAFVGGLRYEAPRVNGAGKVVGWKTVFDPHRPFAIDMAGFAVNLRLILQRSQAYFKLRGVKGGYQESSLLRELVTLNDLEPKAANCTKILVWHTRTEKPVLVNEGKKGFTDPSVEI

SEQ ID NO: 8969 - protein, 334 aa, Homo sapiens; identical to SEQ ID NO: 8968
  Payload ID: 1819;
  Gene Symbol: B3GAT1;
  Gene Name: beta-1,3-glucuronyltransferase 1;
  Uniprot ID:  Q9P2W7;
  ENSP ID: ENSP00000376359

SEQ ID NO: 8970 - protein, 334 aa, Homo sapiens; identical to SEQ ID NO: 8968
  Payload ID: 1819;
  Gene Symbol: B3GAT1;
  Gene Name: beta-1,3-glucuronyltransferase 1;
  Uniprot ID:  Q9P2W7;
  ENSP ID: ENSP00000433847

SEQ ID NO: 8971 - protein, 323 aa, Homo sapiens
  Payload ID: 1820;
  Gene Symbol: B3GAT2;
  Gene Name: beta-1,3-glucuronyltransferase 2;
  Uniprot ID:  Q9NPZ5;
  ENSP ID: ENSP00000230053
MKSALFTRFFILLPWILIVIIMLDVDTRRPVPPLTPRPYFSPYAVGRGGARLPLRRGGPAHGTQKRNQSRPQPQPEPQLPTIYAITPTYSRPVQKAELTRLANTFRQVAQLHWILVEDAAARSELVSRFLARAGLPSTHLHVPTPRRYKRPGLPRATEQRNAGLAWLRQRHQHQRAQPGVLFFADDDNTYSLELFQEMRTTRKVSVWPVGLVGGRRYERPLVENGKVVGWYTGWRADRPFAIDMAGFAVSLQVILSNPKAVFKRRGSQPGMQESDFLKQITTVEELEPKANNCTKVLVWHTRTEKVNLANEPKYHLDTVKIEV

SEQ ID NO: 8972 - protein, 251 aa, Homo sapiens
  Payload ID: 1820;
  Gene Symbol: B3GAT2;
  Gene Name: beta-1,3-glucuronyltransferase 2;
  ENSP ID: ENSP00000481320
MKSALFTRFFILLPWILIVIIMLDVDTRRPVPPLTPRPYFSPYAVGRGGARLPLRRGGPAHGTQKRNQSRPQPQPEPQLPTIYAITPTYSRPVQKAELTRLANTFRQVAQLHWILVEDAAARSELMRTTRKVSVWPVGLVGGRRYERPLVENGKVVGWYTGWRADRPFAIDMAGFAVSLQVILSNPKAVFKRRGSQPGMQESDFLKQITTVEELEPKANNCTKVLVWHTRTEKVNLANEPKYHLDTVKIEV

SEQ ID NO: 8973 - protein, 335 aa, Homo sapiens
  Payload ID: 1821;
  Gene Symbol: B3GAT3;
  Gene Name: beta-1,3-glucuronyltransferase 3;
  Uniprot ID:  O94766;
  ENSP ID: ENSP00000265471
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 8974 - protein, 319 aa, Homo sapiens
  Payload ID: 1821;
  Gene Symbol: B3GAT3;
  Gene Name: beta-1,3-glucuronyltransferase 3;
  ENSP ID: ENSP00000431359
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRSLAVSPRLECSSAILA

SEQ ID NO: 8975 - protein, 315 aa, Homo sapiens
  Payload ID: 1821;
  Gene Symbol: B3GAT3;
  Gene Name: beta-1,3-glucuronyltransferase 3;
  Uniprot ID:  O94766;
  ENSP ID: ENSP00000432474
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRTESRCVTQAGVQ

SEQ ID NO: 8976 - protein, 38 aa, Homo sapiens
  Payload ID: 1821;
  Gene Symbol: B3GAT3;
  Gene Name: beta-1,3-glucuronyltransferase 3;
  ENSP ID: ENSP00000432604
MKLKLKNVFLAYFLVSIAGLLYALVQLVSASSTKQKAR

SEQ ID NO: 8977 - protein, 223 aa, Homo sapiens
  Payload ID: 1821;
  Gene Symbol: B3GAT3;
  Gene Name: beta-1,3-glucuronyltransferase 3;
  ENSP ID: ENSP00000432854
MKLKLKNVFLAYFLVSIAGLLYALVQLAKGMDRTLPLMQRFRDSATALSSGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYS

SEQ ID NO: 8978 - protein, 331 aa, Homo sapiens
  Payload ID: 1822;
  Gene Symbol: B3GALNT1;
  Gene Name: beta-1,3-N-acetylgalactosaminyltransferase 1 (globoside blood group);
  Uniprot ID:  O75752;
  ENSP ID: ENSP00000323479
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 8979 - protein, 331 aa, Homo sapiens; identical to SEQ ID NO: 8978
  Payload ID: 1822;
  Gene Symbol: B3GALNT1;
  Gene Name: beta-1,3-N-acetylgalactosaminyltransferase 1 (globoside blood group);
  Uniprot ID:  O75752;
  ENSP ID: ENSP00000376530

SEQ ID NO: 8980 - protein, 331 aa, Homo sapiens; identical to SEQ ID NO: 8978
  Payload ID: 1822;
  Gene Symbol: B3GALNT1;
  Gene Name: beta-1,3-N-acetylgalactosaminyltransferase 1 (globoside blood group);
  Uniprot ID:  O75752;
  ENSP ID: ENSP00000376532

SEQ ID NO: 8981 - protein, 91 aa, Homo sapiens
  Payload ID: 1822;
  Gene Symbol: B3GALNT1;
  Gene Name: beta-1,3-N-acetylgalactosaminyltransferase 1 (globoside blood group);
  ENSP ID: ENSP00000407027
MASALWTVLPSRMSLRSLKWSLLLLSLLSFFVMWYLSLPHYNVIERVNWMYFYEIHLDVCQLRRVIAAHGFSSKEIITFWQVMLRNTTCHY

SEQ ID NO: 8982 - protein, 150 aa, Homo sapiens
  Payload ID: 1822;
  Gene Symbol: B3GALNT1;
  Gene Name: beta-1,3-N-acetylgalactosaminyltransferase 1 (globoside blood group);
  ENSP ID: ENSP00000417053
MSFFLFSEFTTDLSVLIKHGIQKTTKNLSFNFIWNSTVFLAPWTRLTCWLFPLAALSRGALRLLTPSVKSCCSVAQAGVQWQDLSSLQSPSLRFKQFSCLSLPSRWDYRTFGSRASELLWMASALWTVLPSRMSLRSLKWSLLLLSLLSF

SEQ ID NO: 8983 - protein, 54 aa, Homo sapiens
  Payload ID: 1822;
  Gene Symbol: B3GALNT1;
  Gene Name: beta-1,3-N-acetylgalactosaminyltransferase 1 (globoside blood group);
  ENSP ID: ENSP00000417643
MASALWTVLPSRMSLRSLKWSLLLLSLLSFFVMWYLSLPHYNVIERVNWMYFYE

SEQ ID NO: 8984 - protein, 331 aa, Homo sapiens; identical to SEQ ID NO: 8978
  Payload ID: 1822;
  Gene Symbol: B3GALNT1;
  Gene Name: beta-1,3-N-acetylgalactosaminyltransferase 1 (globoside blood group);
  Uniprot ID:  O75752;
  ENSP ID: ENSP00000418226

SEQ ID NO: 8985 - protein, 65 aa, Homo sapiens
  Payload ID: 1822;
  Gene Symbol: B3GALNT1;
  Gene Name: beta-1,3-N-acetylgalactosaminyltransferase 1 (globoside blood group);
  ENSP ID: ENSP00000418567
MASALWTVLPSRMSLRSLKWSLLLLSLLSFFVMWYLSLPHYNVIERVNWMYFYEYEPIYRQDFHF

SEQ ID NO: 8986 - protein, 29 aa, Homo sapiens
  Payload ID: 1822;
  Gene Symbol: B3GALNT1;
  Gene Name: beta-1,3-N-acetylgalactosaminyltransferase 1 (globoside blood group);
  ENSP ID: ENSP00000419127
MASALWTVLPSRMSLRSLKWSLLLLSLLS

SEQ ID NO: 8987 - protein, 111 aa, Homo sapiens
  Payload ID: 1822;
  Gene Symbol: B3GALNT1;
  Gene Name: beta-1,3-N-acetylgalactosaminyltransferase 1 (globoside blood group);
  ENSP ID: ENSP00000419476
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYE

SEQ ID NO: 8988 - protein, 41 aa, Homo sapiens
  Payload ID: 1822;
  Gene Symbol: B3GALNT1;
  Gene Name: beta-1,3-N-acetylgalactosaminyltransferase 1 (globoside blood group);
  ENSP ID: ENSP00000420059
MASALWTVLPSRMSLRSLKWSLLLLSLLSFFVMWYLSLPHY

SEQ ID NO: 8989 - protein, 331 aa, Homo sapiens; identical to SEQ ID NO: 8978
  Payload ID: 1822;
  Gene Symbol: B3GALNT1;
  Gene Name: beta-1,3-N-acetylgalactosaminyltransferase 1 (globoside blood group);
  Uniprot ID:  O75752;
  ENSP ID: ENSP00000420163

SEQ ID NO: 8990 - protein, 58 aa, Homo sapiens
  Payload ID: 1822;
  Gene Symbol: B3GALNT1;
  Gene Name: beta-1,3-N-acetylgalactosaminyltransferase 1 (globoside blood group);
  ENSP ID: ENSP00000420604
MASALWTVLPSRMSLRSLKWSLLLLSLLSFFVMWYLSLPHYNVIERVNWMYFYEYEPI

SEQ ID NO: 8991 - protein, 326 aa, Homo sapiens
  Payload ID: 1823;
  Gene Symbol: B3GALNT2;
  Gene Name: beta-1,3-N-acetylgalactosaminyltransferase 2;
  Uniprot ID:  Q8NCR0;
  ENSP ID: ENSP00000315678
MRNWLVLLCPCVLGAALHLWLRLRSPPPACASGAGPAGGVSLLLPRLECNGAVSAHPNLHLPGSRDSPASASQVAGITDQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQGKFAS

SEQ ID NO: 8992 - protein, 500 aa, Homo sapiens
  Payload ID: 1823;
  Gene Symbol: B3GALNT2;
  Gene Name: beta-1,3-N-acetylgalactosaminyltransferase 2;
  Uniprot ID:  Q8NCR0;
  ENSP ID: ENSP00000355559
MRNWLVLLCPCVLGAALHLWLRLRSPPPACASGAGPADQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQEGDALLHNLHSRPQRLIDHIRNLHEEDALLKEESSIYDDIVFVDVVDTYRNVPAKLLNFYRWTVETTSFNLLLKTDDDCYIDLEAVFNRIVQKNLDGPNFWWGNFRLNWAVDRTGKWQELEYPSPAYPAFACGSGYVISKDIVKWLASNSGRLKTYQGEDVSMGIWMAAIGPKRYQDSLWLCEKTCETGMLSSPQYSPWELTELWKLKERCGDPCRCQAR

SEQ ID NO: 8993 - protein, 92 aa, Homo sapiens
  Payload ID: 1823;
  Gene Symbol: B3GALNT2;
  Gene Name: beta-1,3-N-acetylgalactosaminyltransferase 2;
  ENSP ID: ENSP00000481548
MRNWLVLLCPCVLGAALHLWLRLRSPPPACASGAGPADQLALFPQWKSTHYDVVVGVLSARNNHELRNVIRSTWMRHLLQHPTLSQRFESGN

SEQ ID NO: 8994 - protein, 326 aa, Homo sapiens; identical to SEQ ID NO: 8991
  Payload ID: 1823;
  Gene Symbol: B3GALNT2;
  Gene Name: Beta-1,3-N-acetylgalactosaminyltransferase 2;
  ENSP ID: ENSP00000489219

SEQ ID NO: 8995 - protein, 92 aa, Homo sapiens; identical to SEQ ID NO: 8993
  Payload ID: 1823;
  Gene Symbol: B3GALNT2;
  Gene Name: Beta-1,3-N-acetylgalactosaminyltransferase 2;
  ENSP ID: ENSP00000489249

SEQ ID NO: 8996 - protein, 500 aa, Homo sapiens; identical to SEQ ID NO: 8992
  Payload ID: 1823;
  Gene Symbol: B3GALNT2;
  Gene Name: Beta-1,3-N-acetylgalactosaminyltransferase 2;
  ENSP ID: ENSP00000489342

SEQ ID NO: 8997 - protein, 415 aa, Homo sapiens
  Payload ID: 1824;
  Gene Symbol: B4GAT1;
  Gene Name: beta-1,4-glucuronyltransferase 1;
  Uniprot ID:  O43505;
  ENSP ID: ENSP00000309096
MQMSYAIRCAFYQLLLAALMLVAMLQLLYLSLLSGLHGQEEQDQYFEFFPPSPRSVDQVKAQLRTALASGGVLDASGDYRVYRGLLKTTMDPNDVILATHASVDNLLHLSGLLERWEGPLSVSVFAATKEEAQLATVLAYALSSHCPDMRARVAMHLVCPSRYEAAVPDPREPGEFALLRSCQEVFDKLARVAQPGINYALGTNVSYPNNLLRNLAREGANYALVIDVDMVPSEGLWRGLREMLDQSNQWGGTALVVPAFEIRRARRMPMNKNELVQLYQVGEVRPFYYGLCTPCQAPTNYSRWVNLPEESLLRPAYVVPWQDPWEPFYVAGGKVPTFDERFRQYGFNRISQACELHVAGFDFEVLNEGFLVHKGFKEALKFHPQKEAENQHNKILYRQFKQELKAKYPNSPRRC

SEQ ID NO: 8998 - protein, 533 aa, Homo sapiens
  Payload ID: 1825;
  Gene Symbol: B4GALNT1;
  Gene Name: beta-1,4-N-acetyl-galactosaminyl transferase 1;
  Uniprot ID:  Q00973;
  ENSP ID: ENSP00000341562
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 8999 - protein, 478 aa, Homo sapiens
  Payload ID: 1825;
  Gene Symbol: B4GALNT1;
  Gene Name: beta-1,4-N-acetyl-galactosaminyl transferase 1;
  Uniprot ID:  Q00973;
  ENSP ID: ENSP00000401601
MWLGRRALCALVLLLACASLGLLYASTRDAPGLRLPLAPWAPPQSPRRPELPDLAPEPRYAHIPVRIKEQVVGSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 9000 - protein, 120 aa, Homo sapiens
  Payload ID: 1825;
  Gene Symbol: B4GALNT1;
  Gene Name: beta-1,4-N-acetyl-galactosaminyl transferase 1;
  ENSP ID: ENSP00000446566
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQ

SEQ ID NO: 9001 - protein, 231 aa, Homo sapiens
  Payload ID: 1825;
  Gene Symbol: B4GALNT1;
  Gene Name: beta-1,4-N-acetyl-galactosaminyl transferase 1;
  ENSP ID: ENSP00000447076
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGEPDCLPRHLGRGRGSDWSYSHWRGSGRSHPCQPRAGPTQQATTTGHLQQPKLPDQHSRHSPVLHRGT

SEQ ID NO: 9002 - protein, 127 aa, Homo sapiens
  Payload ID: 1825;
  Gene Symbol: B4GALNT1;
  Gene Name: beta-1,4-N-acetyl-galactosaminyl transferase 1;
  ENSP ID: ENSP00000447750
  MOD_RES (1)..(1): Any amino acid
XSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTGSNAMSFLPSPVLHRGT

SEQ ID NO: 9003 - protein, 237 aa, Homo sapiens
  Payload ID: 1825;
  Gene Symbol: B4GALNT1;
  Gene Name: beta-1,4-N-acetyl-galactosaminyl transferase 1;
  ENSP ID: ENSP00000447945
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADT

SEQ ID NO: 9004 - protein, 96 aa, Homo sapiens
  Payload ID: 1825;
  Gene Symbol: B4GALNT1;
  Gene Name: beta-1,4-N-acetyl-galactosaminyl transferase 1;
  ENSP ID: ENSP00000448340
MWLGRRALCALVLLLACASLGLLYASTRDAPGLRLPLAPWAPPQSPRRPELPDLAPEPRYAHIPVRIKEQVVGAEGCLCHKRAGVPGLSVEEPVPS

SEQ ID NO: 9005 - protein, 328 aa, Homo sapiens
  Payload ID: 1825;
  Gene Symbol: B4GALNT1;
  Gene Name: beta-1,4-N-acetyl-galactosaminyl transferase 1;
  Uniprot ID:  Q00973;
  ENSP ID: ENSP00000448500
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTGARPGWRDGQAGQTEKNQKGWSGQMAEGMGGIWAMARAVQPHNGCFNWTSRARGRKGAFVHLGLEQARGKPEPWVCLPFRPTVGGPRKRLV

SEQ ID NO: 9006 - protein, 151 aa, Homo sapiens
  Payload ID: 1825;
  Gene Symbol: B4GALNT1;
  Gene Name: beta-1,4-N-acetyl-galactosaminyl transferase 1;
  ENSP ID: ENSP00000448577
  MOD_RES (1)..(1): Any amino acid
XMPFGKGWFAGRNLAVSQVTTKYVLWVDDDFVFTARTRLERLVDVLERTPLDLARLEATSLSLQVGGAVREISGFATTYRQLLSVEPGAPGLGNCLRQRRGFHHELVGFPGCVVTDGVVNFFLARTDKVREVGFDPRLSRVAHLEFFLDGL

SEQ ID NO: 9007 - protein, 81 aa, Homo sapiens
  Payload ID: 1825;
  Gene Symbol: B4GALNT1;
  Gene Name: beta-1,4-N-acetyl-galactosaminyl transferase 1;
  ENSP ID: ENSP00000449534
MWLGRRALCALVLLLACASLGLLYASTRDAPGLRLPLAPWAPPQSPRRPELPDLAPEPRYAHIPVRIKEQVVGLLAWNNCS

SEQ ID NO: 9008 - protein, 328 aa, Homo sapiens; identical to SEQ ID NO: 9005
  Payload ID: 1825;
  Gene Symbol: B4GALNT1;
  Gene Name: beta-1,4-N-acetyl-galactosaminyl transferase 1;
  Uniprot ID:  Q00973;
  ENSP ID: ENSP00000450303

SEQ ID NO: 9009 - protein, 304 aa, Homo sapiens
  Payload ID: 1825;
  Gene Symbol: B4GALNT1;
  Gene Name: beta-1,4-N-acetyl-galactosaminyl transferase 1;
  ENSP ID: ENSP00000473533
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTAQYNISALVTIATKTFLRYDRLRALITSIRRFYPTVTVVIADDSDKPERVSGPYVEHYLMPFGKVCS

SEQ ID NO: 9010 - protein, 566 aa, Homo sapiens
  Payload ID: 1826;
  Gene Symbol: B4GALNT2;
  Gene Name: beta-1,4-N-acetyl-galactosaminyl transferase 2;
  Uniprot ID:  Q8NHY0;
  ENSP ID: ENSP00000300404
MGSAGFSVGKFHVEVASRGRECVSGTPECGNRLGSAGFGALCLELRGADPAWGPFAAHGRSRRQGSRFLWLLKILVIILVLGIVGFMFGSMFLQAVFSSPKPELPSPAPGVQKLKLLPEERLRNLFSYDGIWLFPKNQCKCEANKEQGGYNFQDAYGQSDLPAVKARRQAEFEHFQRREGLPRPLPLLVQPNLPFGYPVHGVEVMPLHTVPIPGLQFEGPDAPVYEVTLTASLGTLNTLADVPDSVVQGRGQKQLIISTSDRKLLKFILQHVTYTSTGYQHQKVDIVSLESRSSVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTELDVVGGSVLGNVFQFKLLLEQSENGACLHKRMGFFQPLDGFPSCVVTSGVVNFFLAHTERLQRVGFDPRLQRVAHSEFFIDGLGTLLVGSCPEVIIGHQSRSPVVDSELAALEKTYNTYRSNTLTRVQFKLALHYFKNHLQCAA

SEQ ID NO: 9011 - protein, 506 aa, Homo sapiens
  Payload ID: 1826;
  Gene Symbol: B4GALNT2;
  Gene Name: beta-1,4-N-acetyl-galactosaminyl transferase 2;
  Uniprot ID:  Q8NHY0;
  ENSP ID: ENSP00000377022
MTSGGSRFLWLLKILVIILVLGIVGFMFGSMFLQAVFSSPKPELPSPAPGVQKLKLLPEERLRNLFSYDGIWLFPKNQCKCEANKEQGGYNFQDAYGQSDLPAVKARRQAEFEHFQRREGLPRPLPLLVQPNLPFGYPVHGVEVMPLHTVPIPGLQFEGPDAPVYEVTLTASLGTLNTLADVPDSVVQGRGQKQLIISTSDRKLLKFILQHVTYTSTGYQHQKVDIVSLESRSSVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTELDVVGGSVLGNVFQFKLLLEQSENGACLHKRMGFFQPLDGFPSCVVTSGVVNFFLAHTERLQRVGFDPRLQRVAHSEFFIDGLGTLLVGSCPEVIIGHQSRSPVVDSELAALEKTYNTYRSNTLTRVQFKLALHYFKNHLQCAA

SEQ ID NO: 9012 - protein, 480 aa, Homo sapiens
  Payload ID: 1826;
  Gene Symbol: B4GALNT2;
  Gene Name: beta-1,4-N-acetyl-galactosaminyl transferase 2;
  Uniprot ID:  Q8NHY0;
  ENSP ID: ENSP00000425510
MFGSMFLQAVFSSPKPELPSPAPGVQKLKLLPEERLRNLFSYDGIWLFPKNQCKCEANKEQGGYNFQDAYGQSDLPAVKARRQAEFEHFQRREGLPRPLPLLVQPNLPFGYPVHGVEVMPLHTVPIPGLQFEGPDAPVYEVTLTASLGTLNTLADVPDSVVQGRGQKQLIISTSDRKLLKFILQHVTYTSTGYQHQKVDIVSLESRSSVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTELDVVGGSVLGNVFQFKLLLEQSENGACLHKRMGFFQPLDGFPSCVVTSGVVNFFLAHTERLQRVGFDPRLQRVAHSEFFIDGLGTLLVGSCPEVIIGHQSRSPVVDSELAALEKTYNTYRSNTLTRVQFKLALHYFKNHLQCAA

SEQ ID NO: 9013 - protein, 998 aa, Homo sapiens [sequence omitted]

SEQ ID NO: 9014 - protein, 636 aa, Homo sapiens
  Payload ID: 1827;
  Gene Symbol: B4GALNT3;
  Gene Name: beta-1,4-N-acetyl-galactosaminyl transferase 3;
  ENSP ID: ENSP00000322953
MARADLVPKARPWGEHQHQFRGRANLHVFEDWCGSSIQQLRRNLHFPLYPHIRTTLRKLAVSPKWTNYGLRIFGYLHPFTDGKIQFAIAADDNAEFWLSLDDQVSGLQLLASVGKTGKEWTAPGEFGKFRSQISKPVSLSASHRYYFEVLHKQNEEGTDHVEVAWRRNDPGAKFTIIDSLSLSLFTNETFLQMDEVGHIPQTAASHVDSSNALPRDEQPPADMLRPDPRDTLYRVPLIPKSHLRHVLPDCPYKPSYLVDGLPLQRYQGLRFVHLSFVYPNDYTRLSHMETHNKCFYQENAYYQDRFSFQEYIKIDQPEKQGLEQPAGFEENLLEESQYGEVAEETPASNNQNARMLEGRQTPASTLEQDATDYRLRSLRKLLAQPREGLLAPFSKRNSTASFPGRTSHIPVQQPEKRKQKPSPEPSQDSPHSDKWPPGHPVKNLPQMRGPRPRPAGDSPRKTQWLNQVESYIAEQRRGDRMRPQAPGRGWHGEEEVVAAAGQEGQVEGEEEGEEEEEEEDMSEVFEYVPVFDPVVNWDQTFSARNLDFQALRTDWIDLSCNTSGNLLLPEQEALEVTRVFLKKLNQRSRGSVDFPIPDILCKWNHVMCGLYIGLFAEYSLSTSFIRVVESIKHFIP

SEQ ID NO: 9015 - protein, 1039 aa, Homo sapiens
  Payload ID: 1828;
  Gene Symbol: B4GALNT4;
  Gene Name: beta-1,4-N-acetyl-galactosaminyl transferase 4;
  Uniprot ID:  Q76KP1;
  ENSP ID: ENSP00000328277
MPRLPVKKIRKQMKLLLLLLLLSCAAWLTYVHLGLVRQGRALRQRLGYGRDGEKLTSETDGRGVHAAPSTQRAEDSSESREEEQAPEGRDLDMLFPGGAGRLPLNFTHQTPPWREEYKGQVNLHVFEDWCGGAVGHLRRNLHFPLFPHTRTTVKKLAVSPKWKNYGLRIFGFIHPARDGDVQFSVASDDNSEFWLSLDESPAAAQLVAFVGKTGSEWTAPGEFTKFSSQVSKPRRLMASRRYYFELLHKQDDRGSDHVEVGWRAFLPGLKFEVISSAHISLYTDESALKMDHVAHVPQSPASHVGGRPPQEETSADMLRPDPRDTFFLTPRMESSSLENVLEPCAYAPTYVVKDFPIARYQGLQFVYLSFVYPNDYTRLTHMETDNKCFYRESPLYLERFGFYKYMKMDKEEGDEDEEDEVQRRAFLFLNPDDFLDDEDEGELLDSLEPTEAAPPRSGPQSPAPAAPAQPGATLAPPTPPRPRDGGTPRHSRALSWAARAARPLPLFLGRAPPPRPAVEQPPPKVYVTRVRPGQRASPRAPAPRAPWPPFPGVFLHPRPLPRVQLRAPPRPPRPHGRRTGGPQATQPRPPARAQATQGGREGQARTLGPAAPTVDSNLSSEARPVTSFLSLSQVSGPQLPGEGEEEEEGEDDGAPGDEAASEDSEEAAGPALGRWREDAIDWQRTFSVGAVDFELLRSDWNDLRCNVSGNLQLPEAEAVDVTAQYMERLNARHGGRFALLRIVNVEKRRDSARGSRFLLELELQERGGGRLRLSEYVFLRLPGARVGDADGESPEPAPAASVRPDGRPELCRPLRLAWRQDVMVHFIVPVKNQARWVAQFLADMAALHARTGDSRFSVVLVDFESEDMDVERALRAARLPRYQYLRRTGNFERSAGLQAGVDAVEDASSIVFLCDLHIHFPPNILDGIRKHCVEGRLAFAPVVMRLSCGSSPRDPHGYWEVNGFGLFGIYKSDFDRVGGMNTEEFRDQWGGEDWELLDRVLQAGLEVERLRLRNFYHHYHSKRGMWSVRSRKGSRTGAS

SEQ ID NO: 9016 - protein, 53 aa, Homo sapiens
  Payload ID: 1828;
  Gene Symbol: B4GALNT4;
  Gene Name: beta-1,4-N-acetyl-galactosaminyl transferase 4;
  ENSP ID: ENSP00000432372
DASSIVFLCDLHIHFPPNILDGIRKHCVEGRLAFAPVVMRLSCGSSPRDPHGS

SEQ ID NO: 9017 - protein, 26 aa, Homo sapiens
  Payload ID: 1828;
  Gene Symbol: B4GALNT4;
  Gene Name: beta-1,4-N-acetyl-galactosaminyl transferase 4;
  ENSP ID: ENSP00000434463
DVERALRAARLPRDRACDSPSPGTST

SEQ ID NO: 9018 - protein, 57 aa, Homo sapiens
  Payload ID: 1829;
  Gene Symbol: B2M;
  Gene Name: beta-2-microglobulin;
  ENSP ID: ENSP00000340858
MSRSVALAVLALLSLSGLERELKKWSIQTCLSARTGLSISCTTLNSPPLKKMSMPAV

SEQ ID NO: 9019 - protein, 101 aa, Homo sapiens
  Payload ID: 1829;
  Gene Symbol: B2M;
  Gene Name: beta-2-microglobulin;
  ENSP ID: ENSP00000437604
MSRSVALAVLALLSLSGLEAIQRTPKIQVYSRHPADIEVDLLKNGERIEKVEHSDLSFSKDWSFYLLYYTEFTPTEKDEYACRVNHVTLSQPKIVKWDRDM

SEQ ID NO: 9020 - protein, 119 aa, Homo sapiens
  Payload ID: 1829;
  Gene Symbol: B2M;
  Gene Name: beta-2-microglobulin;
  Uniprot ID:  P61769;
  ENSP ID: ENSP00000452780
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 9021 - protein, 51 aa, Homo sapiens
  Payload ID: 1829;
  Gene Symbol: B2M;
  Gene Name: beta-2-microglobulin;
  ENSP ID: ENSP00000452861
MSRSVALAVLALLSLSGLEAIQHSGLLTSSSREWKVKFPELLCVWVSSIRH

SEQ ID NO: 9022 - protein, 71 aa, Homo sapiens
  Payload ID: 1829;
  Gene Symbol: B2M;
  Gene Name: beta-2-microglobulin;
  ENSP ID: ENSP00000453186
GFHPSDIEVDLLKNGERIEKVEHSDLSFSKDWSFYLLYYTEFTPTEKDEYACRVNHVTLSQPKIVKWDRDM

SEQ ID NO: 9023 - protein, 119 aa, Homo sapiens; identical to SEQ ID NO: 9020
  Payload ID: 1829;
  Gene Symbol: B2M;
  Gene Name: beta-2-microglobulin;
  Uniprot ID:  P61769;
  ENSP ID: ENSP00000453191

SEQ ID NO: 9024 - protein, 119 aa, Homo sapiens; identical to SEQ ID NO: 9020
  Payload ID: 1829;
  Gene Symbol: B2M;
  Gene Name: beta-2-microglobulin;
  Uniprot ID:  P61769;
  ENSP ID: ENSP00000453350

SEQ ID NO: 9025 - protein, 119 aa, Homo sapiens; identical to SEQ ID NO: 9020
  Payload ID: 1829;
  Gene Symbol: B2M;
  Gene Name: beta-2-microglobulin;
  Uniprot ID:  P61769;
  ENSP ID: ENSP00000481426

SEQ ID NO: 9026 - protein, 101 aa, Homo sapiens; identical to SEQ ID NO: 9019
  Payload ID: 1829;
  Gene Symbol: B2M;
  Gene Name: beta-2-microglobulin;
  ENSP ID: ENSP00000483449

SEQ ID NO: 9027 - protein, 51 aa, Homo sapiens; identical to SEQ ID NO: 9021
  Payload ID: 1829;
  Gene Symbol: B2M;
  Gene Name: beta-2-microglobulin;
  ENSP ID: ENSP00000488042

SEQ ID NO: 9028 - protein, 71 aa, Homo sapiens; identical to SEQ ID NO: 9022
  Payload ID: 1829;
  Gene Symbol: B2M;
  Gene Name: beta-2-microglobulin;
  ENSP ID: ENSP00000488177

SEQ ID NO: 9029 - protein, 119 aa, Homo sapiens; identical to SEQ ID NO: 9020
  Payload ID: 1829;
  Gene Symbol: B2M;
  Gene Name: beta-2-microglobulin;
  Uniprot ID:  P61769;
  ENSP ID: ENSP00000488321

SEQ ID NO: 9030 - protein, 57 aa, Homo sapiens; identical to SEQ ID NO: 9018
  Payload ID: 1829;
  Gene Symbol: B2M;
  Gene Name: beta-2-microglobulin;
  ENSP ID: ENSP00000488360

SEQ ID NO: 9031 - protein, 119 aa, Homo sapiens; identical to SEQ ID NO: 9020
  Payload ID: 1829;
  Gene Symbol: B2M;
  Gene Name: beta-2-microglobulin;
  Uniprot ID:  P61769;
  ENSP ID: ENSP00000488548

SEQ ID NO: 9032 - protein, 547 aa, Homo sapiens
  Payload ID: 1830;
  Gene Symbol: BCO1;
  Gene Name: beta-carotene oxygenase 1;
  Uniprot ID:  Q9HAY6;
  ENSP ID: ENSP00000258168
MDIIFGRNRKEQLEPVRAKVTGKIPAWLQGTLLRNGPGMHTVGESRYNHWFDGLALLHSFTIRDGEVYYRSKYLRSDTYNTNIEANRIVVSEFGTMAYPDPCKNIFSKAFSYLSHTIPDFTDNCLINIMKCGEDFYATSETNYIRKINPQTLETLEKVDYRKYVAVNLATSHPHYDEAGNVLNMGTSIVEKGKTKYVIFKIPATVPEGKKQGKSPWKHTEVFCSIPSRSLLSPSYYHSFGVTENYVIFLEQPFRLDILKMATAYIRRMSWASCLAFHREEKTYIHIIDQRTRQPVQTKFYTDAMVVFHHVNAYEEDGCIVFDVIAYEDNSLYQLFYLANLNQDFKENSRLTSVPTLRRFAVPLHVDKNAEVGTNLIKVASTTATALKEEDGQVYCQPEFLYEGLELPRVNYAHNGKQYRYVFATGVQWSPIPTKIIKYDILTKSSLKWREDDCWPAEPLFVPAPGAKDEDDGVILSAIVSTDPQKLPFLLILDAKSFTELARASVDVDMHMDLHGLFITDMDWDTKKQAASEEQRDRASDCHGAPLT

SEQ ID NO: 9033 - protein, 162 aa, Homo sapiens
  Payload ID: 1830;
  Gene Symbol: BCO1;
  Gene Name: beta-carotene oxygenase 1;
  ENSP ID: ENSP00000455219
MDIIFGRNRKEQLEPVRAKVTGKIPAWLQGTLLRNGPGMHTVGESRYNHWFDGLALLHSFTIRDGEVYYRSKYLRSDTYNTNIEANRIVVSEFGTMAYPDPCKNIFSKAFSYLSHTIPDFTDNCLINIMKCGEDFYATSETNYIRKINPQTLETLEKVSTHM

SEQ ID NO: 9034 - protein, 81 aa, Homo sapiens
  Payload ID: 1830;
  Gene Symbol: BCO1;
  Gene Name: beta-carotene oxygenase 1;
  ENSP ID: ENSP00000457910
MDIIFGRNRKEQLEPVRAKVTGKIPAWLQGTLLRNGPGMHTVGESRYNHWFDGLALLHSFTIRDELSPTCLTPSPISPTTA

SEQ ID NO: 9035 - protein, 579 aa, Homo sapiens
  Payload ID: 1831;
  Gene Symbol: BCO2;
  Gene Name: beta-carotene oxygenase 2;
  Uniprot ID:  Q9BYV7;
  ENSP ID: ENSP00000350314
MFFRVFLHFIRSHSATAVDFLPVMVHRLPVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDLDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFILVLDAKNFEELGRAEVPVQMPYGFHGTFIPI

SEQ ID NO: 9036 - protein, 506 aa, Homo sapiens
  Payload ID: 1831;
  Gene Symbol: BCO2;
  Gene Name: beta-carotene oxygenase 2;
  Uniprot ID:  Q9BYV7;
  ENSP ID: ENSP00000354338
MFFRVFLHFIRSHSATAVDFLPVMVHRLPVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFILVLDAKNFEELGRAEVPVQMPYGFHGTFIPI

SEQ ID NO: 9037 - protein, 545 aa, Homo sapiens
  Payload ID: 1831;
  Gene Symbol: BCO2;
  Gene Name: beta-carotene oxygenase 2;
  Uniprot ID:  Q9BYV7;
  ENSP ID: ENSP00000414843
MGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDLDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFILVLDAKNFEELGRAEVPVQMPYGFHGTFIPI

SEQ ID NO: 9038 - protein, 474 aa, Homo sapiens
  Payload ID: 1831;
  Gene Symbol: BCO2;
  Gene Name: beta-carotene oxygenase 2;
  Uniprot ID:  Q9BYV7;
  ENSP ID: ENSP00000431802
MALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDLDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLKVWREDGFYPSEPVFVPAPGTNEEDGGVILSVVITPNQNESNFILVLDAKNFEELGRAEVPVQMPYGFHGTFIPI

SEQ ID NO: 9039 - protein, 71 aa, Homo sapiens
  Payload ID: 1831;
  Gene Symbol: BCO2;
  Gene Name: beta-carotene oxygenase 2;
  ENSP ID: ENSP00000431882
  MOD_RES (1)..(1): Any amino acid
XKQADGTIWCSHENLHQEDLEKEGGIEFPQIYYDRFSGKKFGEKMAFIPQNLFLFQHQEPMKKMVGLFFLW

SEQ ID NO: 9040 - protein, 273 aa, Homo sapiens
  Payload ID: 1831;
  Gene Symbol: BCO2;
  Gene Name: beta-carotene oxygenase 2;
  ENSP ID: ENSP00000432045
  MOD_RES (1)..(1): Any amino acid
XYNHWFDGMALLHQFRMAKGTVTYRSKFLQSDTYKANSAKNRIVISEFGTLALPDPCKNVFERFMSRFELPAMTDNTNVNYVRYKGDYYLCTETNFMNKVDIETLEKTEKLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVNKTLK

SEQ ID NO: 9041 - protein, 50 aa, Homo sapiens
  Payload ID: 1831;
  Gene Symbol: BCO2;
  Gene Name: beta-carotene oxygenase 2;
  ENSP ID: ENSP00000434488
MFFRVFLHFIRSHSATAVDFLPVMVHRLPGTIIGLMGWRCFTSSEWQRAQ

SEQ ID NO: 9042 - protein, 98 aa, Homo sapiens
  Payload ID: 1831;
  Gene Symbol: BCO2;
  Gene Name: beta-carotene oxygenase 2;
  ENSP ID: ENSP00000435869
MFFRVFLHFIRSHSATAVDFLPVMVHRLPVFKRYMGNTPQKKAVFGQCRGLPCVAPLLTTVEEAPRGISARVWGHFPKWLNGSLLRIGPGKFEFGKDK

SEQ ID NO: 9043 - protein, 539 aa, Homo sapiens
  Payload ID: 1831;
  Gene Symbol: BCO2;
  Gene Name: beta-carotene oxygenase 2;
  Uniprot ID:  Q9BYV7;
  ENSP ID: ENSP00000436615
MGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAAMTDNTNVNYVRYKGDYYLCTETNFMNKVDIETLEKTEKVDWSKFIAVNGATAHPHYDLDGTAYNMGNSFGPYGFSYKVIRVPPEKVDLGETIHGVQVICSIASTEKGKPSYYHSFGMTRNYIIFIEQPLKMNLWKIATSKIRGKAFSDGISWEPQCNTRFHVVEKRTGQLLPGRYYSKPFVTFHQINAFEDQGCVIIDLCCQDNGRTLEVYQLQNLRKAGEGLDQVHNSAAKSFPRRFVLPLNVSLNAPEGDNLSPLSYTSASAVKQADGTIWCSHENLHQEDLEKEGGIEFPQIYYDRFSGKKYHFFYGCGFRHLVGDSLIKVDVVWREDGFYPSEPVFVPAPGTNEEDGGVILSVVITPNQNESNFILVLDAKNFEELGRAEVPVQMPYGFHGTFIPI

SEQ ID NO: 9044 - protein, 50 aa, Homo sapiens; identical to SEQ ID NO: 9041
  Payload ID: 1831;
  Gene Symbol: BCO2;
  Gene Name: beta-carotene oxygenase 2;
  ENSP ID: ENSP00000436956

SEQ ID NO: 9045 - protein, 545 aa, Homo sapiens; identical to SEQ ID NO: 9037
  Payload ID: 1831;
  Gene Symbol: BCO2;
  Gene Name: beta-carotene oxygenase 2;
  Uniprot ID:  Q9BYV7;
  ENSP ID: ENSP00000437053

SEQ ID NO: 9046 - protein, 212 aa, Homo sapiens
  Payload ID: 1831;
  Gene Symbol: BCO2;
  Gene Name: beta-carotene oxygenase 2;
  ENSP ID: ENSP00000476560
  MOD_RES (1)..(1): Any amino acid
XVHRLPVFKRYMGNTPQKKAVFGQCRGLPCVAPLLTTVEEAPRGISARVWGHFPKWLNGSLLRIGPGKFEFGKDKYNHWFDGMALLHQFRMAKGTVTYRSKFLQSDTYKANSAKNRIVISEFGTLALPDPCKNVFERFMSRFELPGKAAGFSYKVIRVPPEKVDLGETIHGVQVICSIASTEKGKPSYYHSFGMTRNYIIFIEQPLKMNLWK

SEQ ID NO: 9047 - protein, 178 aa, Homo sapiens
  Payload ID: 1832;
  Gene Symbol: BTC;
  Gene Name: betacellulin;
  Uniprot ID:  P35070;
  ENSP ID: ENSP00000379092
MDRAARCSGASSLPLLLALALGLVILHCVVADGNSTRSPETNGLLCGDPEENCAATTTQSKRKGHFSRCPKQYKHYCIKGRCRFVVAEQTPSCVCDEGYIGARCERVDLFYLRGDRGQILVICLIAVMVVFIILVIGVCTCCHPLRKRRKRKKKEEEMETLGKDITPINEDIEETNIA

SEQ ID NO: 9048 - protein, 108 aa, Homo sapiens
  Payload ID: 1832;
  Gene Symbol: BTC;
  Gene Name: betacellulin;
  ENSP ID: ENSP00000421747
  MOD_RES (1)..(1): Any amino acid
XLVILHCVVADGNSTRSPETNGLLCGDPEENCAATTTQSKRKGHFSRCPKQYKHYCIKGRCRFVVAEQTPSCVPLRKRRKRKKKEEEMETLGKDITPINEDIEETNIA

SEQ ID NO: 9049 - protein, 2970 aa, Homo sapiens
  Payload ID: 1833;
  Gene Symbol: CRYBG3;
  Gene Name: beta-gamma crystallin domain containing 3;
  Uniprot ID:  Q68DQ2;
  ENSP ID: ENSP00000374273
MSSGRRRGSAPWHSFSRFFAPRSPSRDKEEEEEERPGTSPPPAPGRSAASVENEPMSTSQKKENVLSSEAVKIRQSEDKRNHAEKPVTLPVQEDPKKAYDLSSSTSDTKIGESDRQPKESFFQFLGNLFNISGKSSLGEAKQSSFKDDQDKTEKDLQNPSDHHEDGIKREREIFSGSLRTQTHPTEEQDSNSSELSDAFSLDTTQDSDQETTNLLKQIDGKPEKPSVTYATYRGPRHIGKYLKQQTGLATVNTLDRENESSDSSTNRHIDPGSEIEAGVLPLLLSASTDSSMKGNLLEGPLEDSDCSKTSFNKENSLTNNPELQNIASSNNLLNKNAWGSIERNRSSPSSVTNSSYDGESDSQHHLSCEPVSQTNRNLVCSALLTGSNHRKVPCSPDFQRVTTTENTIKENSTVMSNRTLVQREELVEPQGPAISDFSCSKSDGSDTTEQESTNLPSPNKSIRHEHLQLPESECSDKQTIDSSSKQAATHTNIIALQRHAVTDTEFVNEGKRLSAQDSQKNVAVREIRRETESASAGESIASSHVKAPEDKIESLPKDTDQYFETKAKKLDFRSHDKIPHIRMNKKDLASLNYISESAVVASLGNENAPELKFELNRSHISETPLDSESPQQAEVSPDAKTSLSLDCKKLNFSISPPTFVSGVGMLSKLDIPDLMNEGSPVPIETGNVNIVGISYQPRKCKEENVKNHVEAAGRKSPPPSFCLEYTSAIFEFKEVLSNSEKCQVLPGSEASGPHLTGLELLSFDSGNLSKDCSSILSQDPNRVELVSSNTKANMSIIEKSDSLSLEAKTANIVSKAEIDGQNNVLVESHSGRGKTISLSKVSLSKVEPRNISQDKMSSFPLKITHVPEKPILSELTFLEVEQGKRFQSINHNEIGEKCSDAGLKENCQAELSPAASKYEDKPEPEVDALGSPPALLKSNISWILPPIHDEKISRQMAQNCEAHTCVFHQSLDICGTKKISGHSEMAELSLTNISPKFQETGSMKVNSPFLDSDSSLEKNSSASEDSSFLKVPSVLKLEKKSSSYRKKENIHFLNGGIDSVSSSSSYPEEVSMIVNSHKPQNNLDSIQVTKDLTHEGTSVTNLLYPTTSYLEFETSVSIGTEVTPFQEHFGIYTGKISIDFPTAAQFDNLVEAETGAVAGPAASVNSSGQQCSEASAEHIEARRRAHDQLLDLKSSLLKKADTLIGEIFNSVREELKFKHTVSTCQEHIAIEGIMNLGTLKEDISEKNPSEVTLTEIQQTEGLEEQGMENMSEVKEKPCVSPTVGEKNLLVDPNSMNVSCLLEDKARELVNEIIYVAQEKLRNDTFEDTEDTWDSELQANTSKILNSDSVKPHDVVREFLVSEQPVNQSTQISENKVLNEFFSLSNLASGTESIKGGEIVLYQKSLFSGNGSGLSDSINLQESDTVLLAEDMSHKRLDDRVKTHLFRSEDCNETMEIENVDNNKTETEDRRTLVLNFKWPPLVNDDIHAPGTSKSSLSDSLVCISEKNLPGHSKNTPLAMSDVGKVHKKDNEINIGKIELIPSMLETGKTNKKDAELNILKYEAVPPMIEMGRIHKMDAELNVTKTEPKANVFKMGEVYQMDAESCIEKTEGSAVILGMEKAYKMKDTEGDIGKIEVIPMMPEVKNIHQKDAEGDIVKTEMTPVTVDMENIYQTHAEGDIGKTGTIALSEVENIHQKGGEGISEKAEVIPVTLAMENTYQKDAEGDIGKAEVMPVRLEMENTYPKDTERDGGKTEVMPLALEVVNTYQKNAKGFTGNTEGSVLKMEATYRKTAEEVIKNTEIVPCVLKVKEAHETAPAPLEMEKACKRDVKETIGATVSTPSVIEMEKISPEDRGENIGKHKVLPAVVDIEKIHGTGLELTTKQGEAMLPAFESKTPQEYAEGSVEETKEEPTEIKEGLIAHENRLPTYFRGYESPTLSKDYEGYPAPAMPDFQPGDTTVRLDKRMSLTAIYDKRRETDYSDKGYNLAFVSQDEQENSSFTILYEEPLQEEDKYASAEARQTQSVLFHDTSADSMPVLACERSESRTDLVHHFEKGTKLGETFDSDSSEMFLSVEAKRYKIYPLALSPIYEDDSSQEDILSSEVSPGHHGPRKSRDSENQSSSVLSLLQSVSERLKMNFDEDDREAADEEEEEEEAAVLHKGDLRAGSGERVTFQLPDPSITFYPDDQESVGISKNSYVMPNEPTTSNLQVGLWPEKTSFLQKSDLTSKLHSSLKSAYHQYLQTSQSHSSEKGARFGGIFQEPVSKYFRVQDSPGRLSPFIENVDKQTLRCNPRPGKMVIYDLHESTYKQEVYCNIPDATSWSFPNGVLIKVVRGCWILYEKPHFRGQKCVLEEGEKVLNRDWILQNRRHPQRNFILGSLKRVLKDCSIPEIELFPQSDPACCPVYIQRAVPNLEELNISKSVSFTVKSGVWLAYPDINFKGQATVLEEDHGLFEISTAEMKSLHPLQMGGLKVEMPMNLKVIIYEKPHFHGQAKEFSEHIDSVPNFLKNNGDFHRIGSIRVIGGVWVAYEKEHFKGQQFLLEEGDFEDSNACGALSSPILSFRYLQANFIESSVTLFESDLESGKFIDITNQEISDLEEIGFGSKTRSIHVKSGVWVAYQQKFFCGEQYILEKGKYKCFFDWGGSNNIIMSIRPIQLEPLGINEPPHLLKAFSKPGFQGECIDFTEETSDLTSLMPCSFKVLRGCWLLYYQEDMFVNHCVLEEGLYADLTSCGCPASKVKSLKPIDYVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGKNTQIWYYCRGLFKSKASDTCLDVIGGRDTPGAKVALWTEHGQFRQKWRLNKNGTISSYLSDQLVLDVKGGNYCDKTHVIVNQPLEGEETQKWDIEIL

SEQ ID NO: 9050 - protein, 131 aa, Homo sapiens
  Payload ID: 1833;
  Gene Symbol: CRYBG3;
  Gene Name: beta-gamma crystallin domain containing 3;
  ENSP ID: ENSP00000418420
MNKKKVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGK

SEQ ID NO: 9051 - protein, 406 aa, Homo sapiens
  Payload ID: 1834;
  Gene Symbol: BHMT;
  Gene Name: betaine--homocysteine S- methyltransferase;
  Uniprot ID:  Q93088;
  ENSP ID: ENSP00000274353
MPPVGGKKAKKGILERLNAGEIVIGDGGFVFALEKRGYVKAGPWTPEAAVEHPEAVRQLHREFLRAGSNVMQTFTFYASEDKLENRGNYVLEKISGQEVNEAACDIARQVADEGDALVAGGVSQTPSYLSCKSETEVKKVFLQQLEVFMKKNVDFLIAEYFEHVEEAVWAVETLIASGKPVAATMCIGPEGDLHGVPPGECAVRLVKAGASIIGVNCHFDPTISLKTVKLMKEGLEAARLKAHLMSQPLAYHTPDCNKQGFIDLPEFPFGLEPRVATRWDIQKYAREAYNLGVRYIGGCCGFEPYHIRAIAEELAPERGFLPPASEKHGSWGSGLDMHTKPWVRARARKEYWENLRIASGRPYNPSMSKPDGWGVTKGTAELMQQKEATTEQQLKELFEKQKFKSQ

SEQ ID NO: 9052 - protein, 253 aa, Homo sapiens
  Payload ID: 1834;
  Gene Symbol: BHMT;
  Gene Name: betaine--homocysteine S- methyltransferase;
  ENSP ID: ENSP00000428240
MPPVGGKKAKKGILERLNAGEIVIGDGGFVFALEKRGYVKAGPWTPEAAVEHPEAGASIIGVNCHFDPTISLKTVKLMKEGLEAARLKAHLMSQPLAYHTPDCNKQGFIDLPEFPFGLEPRVATRWDIQKYAREAYNLGVRYIGGCCGFEPYHIRAIAEELAPERGFLPPASEKHGSWGSGLDMHTKPWVRARARKEYWENLRIASGRPYNPSMSKPDGWGVTKGTAELMQQKEATTEQQLKELFEKQKFKSQ

SEQ ID NO: 9053 - protein, 363 aa, Homo sapiens
  Payload ID: 1835;
  Gene Symbol: BHMT2;
  Gene Name: betaine--homocysteine S-methyltransferase 2;
  Uniprot ID:  Q9H2M3;
  ENSP ID: ENSP00000255192
MAPAGRPGAKKGILERLESGEVVIGDGSFLITLEKRGYVKAGLWTPEAVIEHPDAVRQLHMEFLRAGSNVMQTFTFSASEDNMESKWEDVNAAACDLAREVAGKGDALVAGGICQTSIYKYQKDEARIKKLFRQQLEVFAWKNVDFLIAEYFEHVEEAVWAVEVLKESDRPVAVTMCIGPEGDMHDITPGECAVRLVKAGASIVGVNCRFGPDTSLKTMELMKEGLEWAGLKAHLMVQPLGFHAPDCGKEGFVDLPEYPFGLESRVATRWDIQKYAREAYNLGVRYIGGCCGFEPYHIRAIAEELAPERGFLPPASEKHGSWGSGLDMHTKPWIRARARREYWENLLPASGRPFCPSLSKPDF

SEQ ID NO: 9054 - protein, 68 aa, Homo sapiens
  Payload ID: 1835;
  Gene Symbol: BHMT2;
  Gene Name: betaine--homocysteine S-methyltransferase 2;
  ENSP ID: ENSP00000428640
MEFLRAGSNVMQTFTFSASEDNMESKWEDVNAAACDLAREVAGKGDALVAGGICQTSIYKYQKDEARI

SEQ ID NO: 9055 - protein, 58 aa, Homo sapiens
  Payload ID: 1835;
  Gene Symbol: BHMT2;
  Gene Name: betaine--homocysteine S-methyltransferase 2;
  ENSP ID: ENSP00000430155
MAPAGRPGAKKGILERLESGEVVIGDGSDRTPRRSSSTSHGILESRIKCHADFYLFCQ

SEQ ID NO: 9056 - protein, 299 aa, Homo sapiens
  Payload ID: 1835;
  Gene Symbol: BHMT2;
  Gene Name: betaine--homocysteine S-methyltransferase 2;
  Uniprot ID:  Q9H2M3;
  ENSP ID: ENSP00000430278
MAPAGRPGAKKGILERLESGEVVIGDGSFLITLEKRGYVKAGLWTPEAVIEHPDAVRQLHMEFLRAGSNVMQTFTFSASEDNMESKYFEHVEEAVWAVEVLKESDRPVAVTMCIGPEGDMHDITPGECAVRLVKAGASIVGVNCRFGPDTSLKTMELMKEGLEWAGLKAHLMVQPLGFHAPDCGKEGFVDLPEYPFGLESRVATRWDIQKYAREAYNLGVRYIGGCCGFEPYHIRAIAEELAPERGFLPPASEKHGSWGSGLDMHTKPWIRARARREYWENLLPASGRPFCPSLSKPDF

SEQ ID NO: 9057 - protein, 501 aa, Homo sapiens
  Payload ID: 1836;
  Gene Symbol: BACE1;
  Gene Name: beta-site APP-cleaving enzyme 1;
  Uniprot ID:  P56817;
  ENSP ID: ENSP00000318585
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 9058 - protein, 432 aa, Homo sapiens
  Payload ID: 1836;
  Gene Symbol: BACE1;
  Gene Name: beta-site APP-cleaving enzyme 1;
  Uniprot ID:  P56817;
  ENSP ID: ENSP00000402228
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 9059 - protein, 457 aa, Homo sapiens
  Payload ID: 1836;
  Gene Symbol: BACE1;
  Gene Name: beta-site APP-cleaving enzyme 1;
  Uniprot ID:  P56817;
  ENSP ID: ENSP00000403685
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 9060 - protein, 376 aa, Homo sapiens
  Payload ID: 1836;
  Gene Symbol: BACE1;
  Gene Name: beta-site APP-cleaving enzyme 1;
  Uniprot ID:  P56817;
  ENSP ID: ENSP00000422461
MVPFIYLQAHFTLCSGWSSTYRDLRKGVYVPYTQGKWEGELGTDLVSIPHGPNVTVRANIAAITESDKFFINGSNWEGILGLAYAEIARLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 9061 - protein, 476 aa, Homo sapiens
  Payload ID: 1836;
  Gene Symbol: BACE1;
  Gene Name: beta-site APP-cleaving enzyme 1;
  Uniprot ID:  P56817;
  ENSP ID: ENSP00000424536
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 9062 - protein, 467 aa, Homo sapiens
  Payload ID: 1836;
  Gene Symbol: BACE1;
  Gene Name: beta-site APP-cleaving enzyme 1;
  ENSP ID: ENSP00000431848
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKETEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 9063 - protein, 40 aa, Homo sapiens
  Payload ID: 1836;
  Gene Symbol: BACE1;
  Gene Name: beta-site APP-cleaving enzyme 1;
  ENSP ID: ENSP00000434486
MIIGGIDHSLYTGSLWYTPIRREWYYEVIIVRVEINGQDL

SEQ ID NO: 9064 - protein, 51 aa, Homo sapiens
  Payload ID: 1836;
  Gene Symbol: BACE1;
  Gene Name: beta-site APP-cleaving enzyme 1;
  ENSP ID: ENSP00000475171
MIIGGIDHSLYTGSLWYTPIRREWYYEVIIVRVEINGQDLKMDCKEYNYDK

SEQ ID NO: 9065 - protein, 401 aa, Homo sapiens
  Payload ID: 1836;
  Gene Symbol: BACE1;
  Gene Name: beta-site APP-cleaving enzyme 1;
  Uniprot ID:  P56817;
  ENSP ID: ENSP00000475405
MVPFIYLQAHFTLCSGWSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 9066 - protein, 468 aa, Homo sapiens
  Payload ID: 1837;
  Gene Symbol: BACE2;
  Gene Name: beta-site APP-cleaving enzyme 2;
  Uniprot ID:  Q9Y5Z0;
  ENSP ID: ENSP00000327528
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 9067 - protein, 518 aa, Homo sapiens
  Payload ID: 1837;
  Gene Symbol: BACE2;
  Gene Name: beta-site APP-cleaving enzyme 2;
  Uniprot ID:  Q9Y5Z0;
  ENSP ID: ENSP00000332979
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 9068 - protein, 396 aa, Homo sapiens
  Payload ID: 1837;
  Gene Symbol: BACE2;
  Gene Name: beta-site APP-cleaving enzyme 2;
  Uniprot ID:  Q9Y5Z0;
  ENSP ID: ENSP00000333854
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQKLQVLQCLKFPGLSQQRM

SEQ ID NO: 9069 - protein, 191 aa, Homo sapiens
  Payload ID: 1838;
  Gene Symbol: BTRC;
  Gene Name: beta-transducin repeat containing E3 ubiquitin prt ligase;
  ENSP ID: ENSP00000359202
MPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAE

SEQ ID NO: 9070 - protein, 605 aa, Homo sapiens
  Payload ID: 1838;
  Gene Symbol: BTRC;
  Gene Name: beta-transducin repeat containing E3 ubiquitin prt ligase;
  Uniprot ID:  Q9Y297;
  ENSP ID: ENSP00000359206
MDPAEAVLQEKALKFMCSMPRSLWLGCSSLADSMPSLRCLYNPGTGALTAFQNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 9071 - protein, 579 aa, Homo sapiens
  Payload ID: 1838;
  Gene Symbol: BTRC;
  Gene Name: beta-transducin repeat containing E3 ubiquitin prt ligase;
  ENSP ID: ENSP00000377088
MDPAEAVLQEKALKFMCSMPRSLWLGCSSLADSMPSLRCLYNPGTGALTAFQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 9072 - protein, 569 aa, Homo sapiens
  Payload ID: 1838;
  Gene Symbol: BTRC;
  Gene Name: beta-transducin repeat containing E3 ubiquitin prt ligase;
  Uniprot ID:  Q9Y297;
  ENSP ID: ENSP00000385339
MDPAEAVLQEKALKFMNSSEREDCNNGEPPRKIIPEKNSLRQTYNSCARLCLNQETVCLASTAMKTENCVAKTKLANGTSSMIVPKQRKLSASYEKEKELCVKYFEQWSESDQVEFVEHLISQMCHYQHGHINSYLKPMLQRDFITALPARGLDHIAENILSYLDAKSLCAAELVCKEWYRVTSDGMLWKKLIERMVRTDSLWRGLAERRGWGQYLFKNKPPDGNAPPNSFYRALYPKIIQDIETIESNWRCGRHSLQRIHCRSETSKGVYCLQYDDQKIVSGLRDNTIKIWDKNTLECKRILTGHTGSVLCLQYDERVIITGSSDSTVRVWDVNTGEMLNTLIHHCEAVLHLRFNNGMMVTCSKDRSIAVWDMASPTDITLRRVLVGHRAAVNVVDFDDKYIVSASGDRTIKVWNTSTCEFVRTLNGHKRGIACLQYRDRLVVSGSSDNTIRLWDIECGACLRVLEGHEELVRCIRFDNKRIVSGAYDGKIKVWDLVAALDPRAPAGTLCLRTLVEHSGRVFRLQFDEFQIVSSSHDDTILIWDFLNDPAAQAEPPRSPSRTYTYISR

SEQ ID NO: 9073 - protein, 241 aa, Homo sapiens
  Payload ID: 1839;
  Gene Symbol: BID;
  Gene Name: BH3 interacting domain death agonist;
  Uniprot ID:  P55957;
  ENSP ID: ENSP00000318822
MCSGAGVMMARWAARGRAGWRSTVRILSPLGHCEPGVSRSCRAAQAMDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 9074 - protein, 137 aa, Homo sapiens
  Payload ID: 1839;
  Gene Symbol: BID;
  Gene Name: BH3 interacting domain death agonist;
  Uniprot ID:  P55957;
  ENSP ID: ENSP00000344594
MDCEVNNGSSLRDECITNLLVFGFLQSCSDNSFRRELDALGHELPVLAPQWEGYDELQTDGNRSSHSRLGRIEAGASDNNTASAEEETEAAGSVAVERGLHGAATVILKVKKTSSGILPGTSPRSGTAWTVASLRAW

SEQ ID NO: 9075 - protein, 99 aa, Homo sapiens
  Payload ID: 1839;
  Gene Symbol: BID;
  Gene Name: BH3 interacting domain death agonist;
  Uniprot ID:  P55957;
  ENSP ID: ENSP00000382667
MDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 9076 - protein, 99 aa, Homo sapiens; identical to SEQ ID NO: 9075
  Payload ID: 1839;
  Gene Symbol: BID;
  Gene Name: BH3 interacting domain death agonist;
  Uniprot ID:  P55957;
  ENSP ID: ENSP00000382669

SEQ ID NO: 9077 - protein, 195 aa, Homo sapiens
  Payload ID: 1839;
  Gene Symbol: BID;
  Gene Name: BH3 interacting domain death agonist;
  Uniprot ID:  P55957;
  ENSP ID: ENSP00000382674
MDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 9078 - protein, 195 aa, Homo sapiens; identical to SEQ ID NO: 9077
  Payload ID: 1839;
  Gene Symbol: BID;
  Gene Name: BH3 interacting domain death agonist;
  Uniprot ID:  P55957;
  ENSP ID: ENSP00000449236

SEQ ID NO: 9079 - protein, 99 aa, Homo sapiens; identical to SEQ ID NO: 9075
  Payload ID: 1839;
  Gene Symbol: BID;
  Gene Name: BH3 interacting domain death agonist;
  Uniprot ID:  P55957;
  ENSP ID: ENSP00000477773

SEQ ID NO: 9080 - protein, 195 aa, Homo sapiens; identical to SEQ ID NO: 9077
  Payload ID: 1839;
  Gene Symbol: BID;
  Gene Name: BH3 interacting domain death agonist;
  Uniprot ID:  P55957;
  ENSP ID: ENSP00000480414

SEQ ID NO: 9081 - protein, 122 aa, Homo sapiens
  Payload ID: 1839;
  Gene Symbol: BID;
  Gene Name: BH3 interacting domain death agonist;
  ENSP ID: ENSP00000481991
MDCEVNNGSSLRDECITNLLVFGFLQSCSDNSFRRELDALGHELPVLAPQWEGYDELQTDGNRSSHSRLGRIEAGASDNNTASAEEETEAAGSVAVERGLHGAATVVLGQGQHGGCAPEEED

SEQ ID NO: 9082 - protein, 99 aa, Homo sapiens; identical to SEQ ID NO: 9075
  Payload ID: 1839;
  Gene Symbol: BID;
  Gene Name: BH3 interacting domain death agonist;
  Uniprot ID:  P55957;
  ENSP ID: ENSP00000483534

SEQ ID NO: 9083 - protein, 99 aa, Homo sapiens; identical to SEQ ID NO: 9075
  Payload ID: 1839;
  Gene Symbol: BID;
  Gene Name: BH3 interacting domain death agonist;
  Uniprot ID:  P55957;
  ENSP ID: ENSP00000483709

SEQ ID NO: 9084 - protein, 108 aa, Homo sapiens
  Payload ID: 1840;
  Gene Symbol: BLID;
  Gene Name: BH3-like motif containing, cell death inducer;
  Uniprot ID:  Q8IZY5;
  ENSP ID: ENSP00000453153
MVTLLPIEGQEIHFFEILESECVLYTGWIERASGSSIYPEAKARLPLEALLGSNKEPMLPKETVLSLKRYNLGSSAMKRNVPGHVLQRPSYLTRIQVTLLCNSSAEAL

SEQ ID NO: 9085 - protein, 975 aa, Homo sapiens
  Payload ID: 1841;
  Gene Symbol: BICD1;
  Gene Name: bicaudal D homolog 1 (Drosophila);
  Uniprot ID:  Q96G01;
  ENSP ID: ENSP00000281474
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKVSGEASVTVPTIDTYLLHSQGPQTPNIRVSSGTQRKRQFSPSLCDQSRPRTSGASYLQNLLRVPPDPTSTESFLLKGPPSMSEFIQGHRLSKEKRLTVAPPDCQQPAASVPPQCSQLAGRQDCPTVSPDTALPEEQPHSSSQCAPLHCLSKPPHP

SEQ ID NO: 9086 - protein, 827 aa, Homo sapiens
  Payload ID: 1841;
  Gene Symbol: BICD1;
  Gene Name: bicaudal D homolog 1 (Drosophila);
  ENSP ID: ENSP00000379107
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKTIFTFPL

SEQ ID NO: 9087 - protein, 835 aa, Homo sapiens
  Payload ID: 1841;
  Gene Symbol: BICD1;
  Gene Name: bicaudal D homolog 1 (Drosophila);
  Uniprot ID:  Q96G01;
  ENSP ID: ENSP00000446793
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKIVSSLLPPYRHSAHN

SEQ ID NO: 9088 - protein, 93 aa, Homo sapiens
  Payload ID: 1841;
  Gene Symbol: BICD1;
  Gene Name: bicaudal D homolog 1 (Drosophila);
  ENSP ID: ENSP00000447238
MAAEEVLQTVDHYKTEIERLTKELTETTHEKIQAAEYGLVVLEEKLTLKQQYDELEAEYDSLKQELEQLKEGPLLLKDVIYDILNQLAFQFSV

SEQ ID NO: 9089 - protein, 79 aa, Homo sapiens
  Payload ID: 1841;
  Gene Symbol: BICD1;
  Gene Name: bicaudal D homolog 1 (Drosophila);
  ENSP ID: ENSP00000447663
MAAEEVLQTVDHYKTEIERLTKELTETTHEKIQAAEYGLVVLEEKLTLKQQYDELEAEYDSLKQELEQLKEGPLLVRED

SEQ ID NO: 9090 - protein, 93 aa, Homo sapiens
  Payload ID: 1841;
  Gene Symbol: BICD1;
  Gene Name: bicaudal D homolog 1 (Drosophila);
  Uniprot ID:  Q96G01;
  ENSP ID: ENSP00000448933
MAAEEVLQTVDHYKTEIERLTKELTETTHEKIQAAEYGLVVLEEKLTLKQQYDELEAEYDSLKQELEQLKEVSCLSPLPFLALTPPTRKAHSS

SEQ ID NO: 9091 - protein, 69 aa, Homo sapiens
  Payload ID: 1841;
  Gene Symbol: BICD1;
  Gene Name: bicaudal D homolog 1 (Drosophila);
  ENSP ID: ENSP00000475837
  MOD_RES (1)..(1): Any amino acid
XSRQRAAARELAPMIDKDKEALMEEILKLKSLLSTKREQIATLRAVLKANKQAQCLLMKSVNAYEAPSI

SEQ ID NO: 9092 - protein, 173 aa, Homo sapiens
  Payload ID: 1841;
  Gene Symbol: BICD1;
  Gene Name: bicaudal D homolog 1 (Drosophila);
  ENSP ID: ENSP00000481877
  MOD_RES (1)..(1): Any amino acid
XAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKVSGEASVTVPTIDTYLLHSQGPQTPNIRVSSGTQRKRYACSDLHSTVQWPDFS

SEQ ID NO: 9093 - protein, 855 aa, Homo sapiens
  Payload ID: 1842;
  Gene Symbol: BICD2;
  Gene Name: bicaudal D homolog 2 (Drosophila);
  Uniprot ID:  Q8TD16;
  ENSP ID: ENSP00000349351
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSVSHTCACASDRAEGTGLANQVFCSEKHSIYCD

SEQ ID NO: 9094 - protein, 824 aa, Homo sapiens
  Payload ID: 1842;
  Gene Symbol: BICD2;
  Gene Name: bicaudal D homolog 2 (Drosophila);
  Uniprot ID:  Q8TD16;
  ENSP ID: ENSP00000364662
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSL

SEQ ID NO: 9095 - protein, 506 aa, Homo sapiens
  Payload ID: 1843;
  Gene Symbol: BICC1;
  Gene Name: BicC family RNA binding prt 1;
  ENSP ID: ENSP00000263103
MEQLDVFISIKPKPKQPSKSVIVKSVERNALNMYEARKCLLGLESSGVTIATSPSPASCPAGLACPSLDILASAGLGLTGLGLLGPTTLSLNTSTTPNSLLNALNSSVSPLQSPSSGTPSPTLWAPPLANTSSATGFSAIPHLMIPSTAQATLTNILLSGVPTYGHTAPSPPPGLTPVDVHINSMQTEGKKISAALNGHAQSPDIKYGAISTSSLGEKVLSANHGDPSIQTSGSEQTSPKSSPTEGCNDAFVEVGMPRSPSHSGNAGDLKQMMCPSKVSCAKRQTVELLQGTKNSHLHSTDRLLSDPELSATESPLADKKAPGSERAAERAAAAQQNSERAHLAPRSSYVNMQAFDYEQKKLLATKAMLKKPVVTEVRTPTNTWSGLGFSKSMPAETIKELRRANHVSYKPTMTTTYEGSSMSLSRSNSREHLGGGSESDNWRDRNGIGPGSHSEFAASIGSPKRKQNKSSERCVLCTLLGIPRLECVYLGWSITDCGLSDFKCLV

SEQ ID NO: 9096 - protein, 974 aa, Homo sapiens
  Payload ID: 1843;
  Gene Symbol: BICC1;
  Gene Name: BicC family RNA binding prt 1;
  Uniprot ID:  Q9H694;
  ENSP ID: ENSP00000362993
MAAQGEPGYLAAQSDPGSNSERSTDSPVPGSEDDLVAGATLHSPEWSEERFRVDRKKLEAMLQAAAEGKGRSGEDFFQKIMEETNTQIAWPSKLKIGAKSKKDPHIKVSGKKEDVKEAKEMIMSVLDTKSNRVTLKMDVSHTEHSHVIGKGGNNIKKVMEETGCHIHFPDSNRNNQAEKSNQVSIAGQPAGVESARVRIRELLPLVLMFELPIAGILQPVPDPNSPSIQHISQTYNISVSFKQRSRMYGATVIVRGSQNNTSAVKEGTAMLLEHLAGSLASAIPVSTQLDIAAQHHLFMMGRNGSNIKHIMQRTGAQIHFPDPSNPQKKSTVYLQGTIESVCLARQYLMGCLPLVLMFDMKEEIEVDPQFIAQLMEQLDVFISIKPKPKQPSKSVIVKSVERNALNMYEARKCLLGLESSGVTIATSPSPASCPAGLACPSLDILASAGLGLTGLGLLGPTTLSLNTSTTPNSLLNALNSSVSPLQSPSSGTPSPTLWAPPLANTSSATGFSAIPHLMIPSTAQATLTNILLSGVPTYGHTAPSPPPGLTPVDVHINSMQTEGKKISAALNGHAQSPDIKYGAISTSSLGEKVLSANHGDPSIQTSGSEQTSPKSSPTEGCNDAFVEVGMPRSPSHSGNAGDLKQMMCPSKVSCAKRQTVELLQGTKNSHLHSTDRLLSDPELSATESPLADKKAPGSERAAERAAAAQQNSERAHLAPRSSYVNMQAFDYEQKKLLATKAMLKKPVVTEVRTPTNTWSGLGFSKSMPAETIKELRRANHVSYKPTMTTTYEGSSMSLSRSNSREHLGGGSESDNWRDRNGIGPGSHSEFAASIGSPKRKQNKSTEHYLSSSNYMDCISSLTGSNGCNLNSSFKGSDLPELFSKLGLGKYTDVFQQQEIDLQTFLTLTDQDLKELGITTFGARRKMLLAISELNKNRRKLFESPNARTSFLEGGASGRLPRQYHSDIASVSGRW

SEQ ID NO: 9097 - protein, 450 aa, Homo sapiens
  Payload ID: 1844;
  Gene Symbol: BFAR;
  Gene Name: bifunctional apoptosis regulator;
  Uniprot ID:  Q9NZS9;
  ENSP ID: ENSP00000261658
MEEPQKSYVNTMDLERDEPLKSTGPQISVSEFSCHCCYDILVNPTTLNCGHSFCRHCLALWWASSKKTECPECREKWEGFPKVSILLRDAIEKLFPDAIRLRFEDIQQNNDIVQSLAAFQKYGNDQIPLAPNTGRANQQMGGGFFSGVLTALTGVAVVLLVYHWSSRESEHDLLVHKAVAKWTAEEVVLWLEQLGPWASLYRERFLSERVNGRLLLTLTEEEFSKTPYTIENSSHRRAILMELERVKALGVKPPQNLWEYKAVNPGRSLFLLYALKSSPRLSLLYLYLFDYTDTFLPFIHTICPLQEDSSGEDIVTKLLDLKEPTWKQWREFLVKYSFLPYQLIAEFAWDWLEVHYWTSRFLIINAMLLSVLELFSFWRIWSRSELKTVPQRMWSHFWKVSTQGLFVAMFWPLIPQFVCNCLFYWALYFNPIINIDLVVKELRRLETQVL

SEQ ID NO: 9098 - protein, 325 aa, Homo sapiens
  Payload ID: 1844;
  Gene Symbol: BFAR;
  Gene Name: bifunctional apoptosis regulator;
  ENSP ID: ENSP00000454476
MEEPQKSYVNTMDLERDEPLKSTGPQISVSEFSCHCCYDILVNPTTLNCGHSFCRHCLALWWASSKKTECPECREKWEGFPKVSILLRLLLTLTEEEFSKTPYTIENSSHRRAILMELERVKALGVKPPQNLWEYKAVNPGRSLFLLYALKSSPRLSLLYLYLFDYTDTFLPFIHTICPLQEDSSGEDIVTKLLDLKEPTWKQWREFLVKYSFLPYQLIAEFAWDWLEVHYWTSRFLIINAMLLSVLELFSFWRIWSRSELKTVPQRMWSHFWKVSTQGLFVAMFWPLIPQFVCNCLFYWALYFNPIINIDLVVKELRRLETQVL

SEQ ID NO: 9099 - protein, 102 aa, Homo sapiens
  Payload ID: 1844;
  Gene Symbol: BFAR;
  Gene Name: bifunctional apoptosis regulator;
  ENSP ID: ENSP00000454606
LYLFDYTDTFLPFIHTICPLQEDSSGEDIVTKLLDLKEPTWKQWREFLVKYSFLPYQLIAEFAWDWLEVHYWTSRFLIINAMLLSVLELFSFWRIWSRSELK

SEQ ID NO: 9100 - protein, 89 aa, Homo sapiens
  Payload ID: 1844;
  Gene Symbol: BFAR;
  Gene Name: bifunctional apoptosis regulator;
  ENSP ID: ENSP00000455428
MEEPQKSYVNTMDLERDEPLKSTGPQISVSEFSCHCCYDILVNPTTLNCGHSFCRHCLALWWASSKKTECPECREKWEGFPKVSILLRL

SEQ ID NO: 9101 - protein, 109 aa, Homo sapiens
  Payload ID: 1844;
  Gene Symbol: BFAR;
  Gene Name: bifunctional apoptosis regulator;
  ENSP ID: ENSP00000456358
MEEPQKSYVNTMDLERDEPLKSTGPQISVSEFSCHCCYDILVNPTTLNCGHSFCRHCLALWWASSKKTECPECREKWEGFPKVSILLRDAIEKLFPDAIRLRFEDIQQN

SEQ ID NO: 9102 - protein, 206 aa, Homo sapiens
  Payload ID: 1844;
  Gene Symbol: BFAR;
  Gene Name: bifunctional apoptosis regulator;
  ENSP ID: ENSP00000456869
  MOD_RES (1)..(1): Any amino acid
XGGGFFSGVLTALTGVAAVNPGRSLFLLYALKSSPRLSLLYLYLFDYTDTFLPFIHTICPLQEDSSGEDIVTKLLDLKEPTWKQWREFLVKYSFLPYQLIAEFAWDWLEVHYWTSRFLIINAMLLSVLELFSFWRIWSRSELKTVPQRMWSHFWKVSTQGLFVAMFWPLIPQFVCNCLFYWALYFNPIINIDLVVKELRRLETQVL

SEQ ID NO: 9103 - protein, 97 aa, Homo sapiens
  Payload ID: 1844;
  Gene Symbol: BFAR;
  Gene Name: bifunctional apoptosis regulator;
  ENSP ID: ENSP00000457165
DSSGEDIVTKLLDLKEPTWKQWREFLVKYSFLPYQLIAEFAWDWLEVHYWTSRFLIINAMLLSVLELFSFWRIWSRSELNVNTAGVRCHLGRQALQK

SEQ ID NO: 9104 - protein, 141 aa, Homo sapiens
  Payload ID: 1844;
  Gene Symbol: BFAR;
  Gene Name: bifunctional apoptosis regulator;
  ENSP ID: ENSP00000457561
MEEPQKSYVNTMDLERDEPLKSTGPQISVSEFSCHCCYDILVNPTTLNCGHSFCRHCLALWWASSKKTECPECREKWEGFPKVSILLRWSCSSITGAAGNLNTTSWSTRLWPNGRRKKLSSGWSSWALGHLFTGKGFYLNE

SEQ ID NO: 9105 - protein, 450 aa, Homo sapiens; identical to SEQ ID NO: 9097
  Payload ID: 1844;
  Gene Symbol: BFAR;
  Gene Name: bifunctional apoptosis regulator;
  Uniprot ID:  Q9NZS9;
  ENSP ID: ENSP00000478190

SEQ ID NO: 9106 - protein, 213 aa, Homo sapiens
  Payload ID: 1844;
  Gene Symbol: BFAR;
  Gene Name: bifunctional apoptosis regulator;
  ENSP ID: ENSP00000481225
MEEPQKSYVNTMDLERDEPLKSTGPQISVSEFSCHCCYDILVNPTTLNCGHSFCRHCLALWWASSKKTECPECREKWEGFPKVSILLRDAIEKLFPDAIRLRFEDIQQNNDIVQSLAAFQKYGNDQIPLAPNTGRANQQMGGGFFSGVLTALTGVAVVLLVYHWSSRESEHDLLVHKAVAKWTAEEVVLWLEQLGPWASLYRERFLSERVNGR

SEQ ID NO: 9107 - protein, 325 aa, Homo sapiens; identical to SEQ ID NO: 9098
  Payload ID: 1844;
  Gene Symbol: BFAR;
  Gene Name: bifunctional apoptosis regulator;
  ENSP ID: ENSP00000487878

SEQ ID NO: 9108 - protein, 89 aa, Homo sapiens; identical to SEQ ID NO: 9100
  Payload ID: 1844;
  Gene Symbol: BFAR;
  Gene Name: bifunctional apoptosis regulator;
  ENSP ID: ENSP00000487995

SEQ ID NO: 9109 - protein, 213 aa, Homo sapiens; identical to SEQ ID NO: 9106
  Payload ID: 1844;
  Gene Symbol: BFAR;
  Gene Name: bifunctional apoptosis regulator;
  ENSP ID: ENSP00000488076

SEQ ID NO: 9110 - protein, 141 aa, Homo sapiens; identical to SEQ ID NO: 9104
  Payload ID: 1844;
  Gene Symbol: BFAR;
  Gene Name: bifunctional apoptosis regulator;
  ENSP ID: ENSP00000488143

SEQ ID NO: 9111 - protein, 206 aa, Homo sapiens; identical to SEQ ID NO: 9102
  Payload ID: 1844;
  Gene Symbol: BFAR;
  Gene Name: bifunctional apoptosis regulator;
  ENSP ID: ENSP00000488487
  MOD_RES (1)..(1): Any amino acid

SEQ ID NO: 9112 - protein, 97 aa, Homo sapiens; identical to SEQ ID NO: 9103
  Payload ID: 1844;
  Gene Symbol: BFAR;
  Gene Name: bifunctional apoptosis regulator;
  ENSP ID: ENSP00000488492

SEQ ID NO: 9113 - protein, 102 aa, Homo sapiens; identical to SEQ ID NO: 9099
  Payload ID: 1844;
  Gene Symbol: BFAR;
  Gene Name: bifunctional apoptosis regulator;
  ENSP ID: ENSP00000488540

SEQ ID NO: 9114 - protein, 109 aa, Homo sapiens; identical to SEQ ID NO: 9101
  Payload ID: 1844;
  Gene Symbol: BFAR;
  Gene Name: bifunctional apoptosis regulator;
  ENSP ID: ENSP00000488837

SEQ ID NO: 9115 - protein, 368 aa, Homo sapiens
  Payload ID: 1845;
  Gene Symbol: BGN;
  Gene Name: biglycan;
  Uniprot ID:  P21810;
  ENSP ID: ENSP00000327336
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 9116 - protein, 238 aa, Homo sapiens
  Payload ID: 1845;
  Gene Symbol: BGN;
  Gene Name: biglycan;
  ENSP ID: ENSP00000402525
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYVRSWEEPAGLQQRAGVRALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLT

SEQ ID NO: 9117 - protein, 418 aa, Homo sapiens
  Payload ID: 1846;
  Gene Symbol: BAAT;
  Gene Name: bile acid CoA:amino acid N-acyltransferase;
  Uniprot ID:  Q14032;
  ENSP ID: ENSP00000259407
MIQLTATPVSALVDEPVHIRATGLIPFQMVSFQASLEDENGDMFYSQAHYRANEFGEVDLNHASSLGGDYMGVHPMGLFWSLKPEKLLTRLLKRDVMNRPFQVQVKLYDLELIVNNKVASAPKASLTLERWYVAPGVTRIKVREGRLRGALFLPPGEGLFPGVIDLFGGLGGLLEFRASLLASRGFASLALAYHNYEDLPRKPEVTDLEYFEEAANFLLRHPKVFGSGVGVVSVCQGVQIGLSMAIYLKQVTATVLINGTNFPFGIPQVYHGQIHQPLPHSAQLISTNALGLLELYRTFETTQVGASQYLFPIEEAQGQFLFIVGEGDKTINSKAHAEQAIGQLKRHGKNNWTLLSYPGAGHLIEPPYSPLCCASTTHDLRLHWGGEVIPHAAAQEHAWKEIQRFLRKHLIPDVTSQL

SEQ ID NO: 9118 - protein, 418 aa, Homo sapiens; identical to SEQ ID NO: 9117
  Payload ID: 1846;
  Gene Symbol: BAAT;
  Gene Name: bile acid CoA:amino acid N-acyltransferase;
  Uniprot ID:  Q14032;
  ENSP ID: ENSP00000378491

SEQ ID NO: 9119 - protein, 418 aa, Homo sapiens; identical to SEQ ID NO: 9117
  Payload ID: 1846;
  Gene Symbol: BAAT;
  Gene Name: bile acid CoA:amino acid N-acyltransferase;
  Uniprot ID:  Q14032;
  ENSP ID: ENSP00000484063

SEQ ID NO: 9120 - protein, 296 aa, Homo sapiens
  Payload ID: 1847;
  Gene Symbol: BLVRA;
  Gene Name: biliverdin reductase A;
  Uniprot ID:  P53004;
  ENSP ID: ENSP00000265523
MNAEPERKFGVVVVGVGRAGSVRMRDLRNPHPSSAFLNLIGFVSRRELGSIDGVQQISLEDALSSQEVEVAYICSESSSHEDYIRQFLNAGKHVLVEYPMTLSLAAAQELWELAEQKGKVLHEEHVELLMEEFAFLKKEVVGKDLLKGSLLFTAGPLEEERFGFPAFSGISRLTWLVSLFGELSLVSATLEERKEDQYMKMTVCLETEKKSPLSWIEEKGPGLKRNRYLSFHFKSGSLENVPNVGVNKNIFLKDQNIFVQKLLGQFSEKELAAEKKRILHCLGLAEEIQKYCCSRK

SEQ ID NO: 9121 - protein, 296 aa, Homo sapiens; identical to SEQ ID NO: 9120
  Payload ID: 1847;
  Gene Symbol: BLVRA;
  Gene Name: biliverdin reductase A;
  Uniprot ID:  P53004;
  ENSP ID: ENSP00000385757

SEQ ID NO: 9122 - protein, 102 aa, Homo sapiens
  Payload ID: 1847;
  Gene Symbol: BLVRA;
  Gene Name: biliverdin reductase A;
  ENSP ID: ENSP00000412005
MNAEPERKFGVVVVGVGRAGSVRMRDLRNPHPSSAFLNLIGFVSRRELGSIDGVQQISLEDALSSQEVEVAYICSESSSHEDYIRQFLNAGKHVLVEYPMTL

SEQ ID NO: 9123 - protein, 206 aa, Homo sapiens
  Payload ID: 1848;
  Gene Symbol: BLVRB;
  Gene Name: biliverdin reductase B;
  Uniprot ID:  P30043;
  ENSP ID: ENSP00000263368
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 9124 - protein, 154 aa, Homo sapiens
  Payload ID: 1848;
  Gene Symbol: BLVRB;
  Gene Name: biliverdin reductase B;
  ENSP ID: ENSP00000470619
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSGGWWDHGGGAELGGTGEAAQGPLKGDAEAIPCYCAFTEHQLCA

SEQ ID NO: 9125 - protein, 163 aa, Homo sapiens
  Payload ID: 1848;
  Gene Symbol: BLVRB;
  Gene Name: biliverdin reductase B;
  ENSP ID: ENSP00000471720
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSGDQPLTGAYTVTLDGRGPSRVISKHDLGHFMLRCLTTDEYDGHSTYPSHQYQ

SEQ ID NO: 9126 - protein, 132 aa, Homo sapiens
  Payload ID: 1849;
  Gene Symbol: BSPH1;
  Gene Name: binder of sperm prt homolog 1;
  Uniprot ID:  Q075Z2;
  ENSP ID: ENSP00000341762
MGSLMLLFVETTRNSSACIFPVILNELSSTVETITHFPEVTDGECVFPFHYKNGTYYDCIKSKARHKWCSLNKTYEGYWKFCSAEDFANCVFPFWYRRLIYWECTDDGEAFGKKWCSLTKNFNKDRIWKYCE

SEQ ID NO: 9127 - protein, 45 aa, Homo sapiens
  Payload ID: 1850;
  Gene Symbol: BLOC1S1;
  Gene Name: biogenesis of lysosomal organelles complex-1, subunit 1;
  ENSP ID: ENSP00000446619
  MOD_RES (1)..(1): Any amino acid
XSFRSRRGPGVPSPQPDVTMLSRLLKEHQAKQNERKELQVWPRPT

SEQ ID NO: 9128 - protein, 153 aa, Homo sapiens
  Payload ID: 1850;
  Gene Symbol: BLOC1S1;
  Gene Name: biogenesis of lysosomal organelles complex-1, subunit 1;
  Uniprot ID:  P78537;
  ENSP ID: ENSP00000447537
MAPGSRGERSSFRSRRGPGVPSPQPDVTMLSRLLKEHQAKQNERKELQEKRRREAITAATCLTEALVDHLNVGVAQAYMNQRKLDHEVKTLQVQAAQFAKQTGQWIGMVENFNQALKEIGDVENWARSIELDMRTIATALEYVYKGQLQSAPS

SEQ ID NO: 9129 - protein, 64 aa, Homo sapiens
  Payload ID: 1850;
  Gene Symbol: BLOC1S1;
  Gene Name: biogenesis of lysosomal organelles complex-1, subunit 1;
  ENSP ID: ENSP00000448171
MNQRKLDHEVKTLQVQAAQFAKQTGQWIGMVENFNQALKVGHTPYLTTPILGPHWLPPVRLPQV

SEQ ID NO: 9130 - protein, 75 aa, Homo sapiens
  Payload ID: 1850;
  Gene Symbol: BLOC1S1;
  Gene Name: biogenesis of lysosomal organelles complex-1, subunit 1;
  ENSP ID: ENSP00000448605
MNQRKLDHEVKTLQVQAAQFAKQTGQWIGMVENFNQALKEIGDVENWARSIELDMRTIATALEYVYKGQLQSAPS

SEQ ID NO: 9131 - protein, 75 aa, Homo sapiens; identical to SEQ ID NO: 9130
  Payload ID: 1850;
  Gene Symbol: BLOC1S1;
  Gene Name: biogenesis of lysosomal organelles complex-1, subunit 1;
  ENSP ID: ENSP00000450218

SEQ ID NO: 9132 - protein, 142 aa, Homo sapiens
  Payload ID: 1850;
  Gene Symbol: BLOC1S1;
  Gene Name: biogenesis of lysosomal organelles complex-1, subunit 1;
  ENSP ID: ENSP00000450328
MAPGSRGERSSFRSRRGPGVPSPQPDVTMLSRLLKEHQAKQNERKELQEKRRREAITAATCLTEALVDHLNVGVAQAYMNQRKLDHEVKTLQVQAAQFAKQTGQWIGMVENFNQALKVGHTPYLTTPILGPHWLPPVRLPQV

SEQ ID NO: 9133 - protein, 142 aa, Homo sapiens
  Payload ID: 1851;
  Gene Symbol: BLOC1S2;
  Gene Name: biogenesis of lysosomal organelles complex-1, subunit 2;
  Uniprot ID:  Q6QNY1;
  ENSP ID: ENSP00000359398
MAAAAEGVLATRSDEPARDDAAVETAEEAKEPAEADITELCRDMFSKMATYLTGELTATSEDYKLLENMNKLTSLKYLEMKDIAINISRNLKDLNQKYAGLQPYLDQINVIEEQVAALEQAAYKLDAYSKKLEAKYKKLEKR

SEQ ID NO: 9134 - protein, 99 aa, Homo sapiens
  Payload ID: 1851;
  Gene Symbol: BLOC1S2;
  Gene Name: biogenesis of lysosomal organelles complex-1, subunit 2;
  Uniprot ID:  Q6QNY1;
  ENSP ID: ENSP00000410865
MFSKMATYLTGELTATSEDYKLLENMNKLTSLKYLEMKDIAINISRNLKDLNQKYAGLQPYLDQINVIEEQVAALEQAAYKLDAYSKKLEAKYKKLEKR

SEQ ID NO: 9135 - protein, 117 aa, Homo sapiens
  Payload ID: 1851;
  Gene Symbol: BLOC1S2;
  Gene Name: biogenesis of lysosomal organelles complex-1, subunit 2;
  ENSP ID: ENSP00000464387
CRDMFSKMATYLTGELTATSEDYKLLENMNKLTSLKYLEMKDIAINISRNLKDLNQKYAGLQPYLDQINVIEEQVAALEQAAYKLDAYSKKLGNRFYFCFDVIKTASCQHILSKHNS

SEQ ID NO: 9136 - protein, 99 aa, Homo sapiens; identical to SEQ ID NO: 9134
  Payload ID: 1851;
  Gene Symbol: BLOC1S2;
  Gene Name: biogenesis of lysosomal organelles complex-1, subunit 2;
  Uniprot ID:  Q6QNY1;
  ENSP ID: ENSP00000481847

SEQ ID NO: 9137 - protein, 95 aa, Homo sapiens
  Payload ID: 1851;
  Gene Symbol: BLOC1S2;
  Gene Name: biogenesis of lysosomal organelles complex-1, subunit 2;
  ENSP ID: ENSP00000484340
MRLPRKSLEVATSEDYKLLENMNKLTSLKYLEMKDIAINISRNLKDLNQKYAGLQPYLDQINVIEEQVAALEQAAYKLDAYSKKLEAKYKKLEKR

SEQ ID NO: 9138 - protein, 202 aa, Homo sapiens
  Payload ID: 1852;
  Gene Symbol: BLOC1S3;
  Gene Name: biogenesis of lysosomal organelles complex-1, subunit 3;
  Uniprot ID:  Q6QNY0;
  ENSP ID: ENSP00000393840
MASQGRRRRPLRRPETVVPGEATETDSERSASSSEEEELYLGPSGPTRGRPTGLRVAGEAAETDSEPEPEPEPTAAPRDLPPLVVQRESAEEAWGTEEAPAPAPARSLLQLRLAESQARLDHDVAAAVSGVYRRAGRDVAALASRLAAAQAAGLAAAHSVRLARGDLCALAERLDIVAGCRLLPDIRGVPGTEPEKDPGPRA

SEQ ID NO: 9139 - protein, 78 aa, Homo sapiens
  Payload ID: 1852;
  Gene Symbol: BLOC1S3;
  Gene Name: biogenesis of lysosomal organelles complex-1, subunit 3;
  ENSP ID: ENSP00000466798
AAAVSGVYRRAGRDVAALASRLAAAQAAGLAAAHSVRLARGDLCALAERLDIVAGCRLLPDIRGVPGTEPEKDPGPRA

SEQ ID NO: 9140 - protein, 202 aa, Homo sapiens; identical to SEQ ID NO: 9138
  Payload ID: 1852;
  Gene Symbol: BLOC1S3;
  Gene Name: biogenesis of lysosomal organelles complex-1, subunit 3;
  Uniprot ID:  Q6QNY0;
  ENSP ID: ENSP00000468281

SEQ ID NO: 9141 - protein, 217 aa, Homo sapiens
  Payload ID: 1853;
  Gene Symbol: BLOC1S4;
  Gene Name: biogenesis of lysosomal organelles complex-1, subunit 4, cappuccino;
  Uniprot ID:  Q9NUP1;
  ENSP ID: ENSP00000318128
MEGSFSDGGALPEGLAEEAEPQGAAWSGDSGTVSQSHSSASGPWEDEGAEDGAPGRDLPLLRRAAAGYAACLLPGAGARPEVEALDASLEDLLTRVDEFVGMLDMLRGDSSHVVSEGVPRIHAKAAEMRRIYSRIDRLEAFVRMVGGRVARMEEQVTKAEAELGTFPRAFKKLLHTMNVPSLFSKSAPSRPQQAGYEAPVLFRTEDYFPCCSERPQL

SEQ ID NO: 9142 - protein, 114 aa, Homo sapiens
  Payload ID: 1854;
  Gene Symbol: BLOC1S5;
  Gene Name: biogenesis of lysosomal organelles complex-1, subunit 5, muted;
  ENSP ID: ENSP00000244777
MSGGGTETPVGCEAAPGGGSKKRDSLGTAGSAHLIIKDLGEIHSRLLDHRPVIQGETRYFVKEFEEKRGLREMRVLENLKNMIHETNEHTLPKCRDTMRDSLSQVLQRYEELSC

SEQ ID NO: 9143 - protein, 187 aa, Homo sapiens
  Payload ID: 1854;
  Gene Symbol: BLOC1S5;
  Gene Name: biogenesis of lysosomal organelles complex-1, subunit 5, muted;
  Uniprot ID:  Q8TDH9;
  ENSP ID: ENSP00000380598
MSGGGTETPVGCEAAPGGGSKKRDSLGTAGSAHLIIKDLGEIHSRLLDHRPVIQGETRYFVKEFEEKRGLREMRVLENLKNMIHETNEHTLPKCRDTMRDSLSQVLQRLQAANDSVCRLQQREQERKKIHSDHLVASEKQHMLQWDNFMKEQPNKRAEVDEEHRKAMERLKEQYAEMEKDLAKFSTF

SEQ ID NO: 9144 - protein, 90 aa, Homo sapiens
  Payload ID: 1854;
  Gene Symbol: BLOC1S5;
  Gene Name: biogenesis of lysosomal organelles complex-1, subunit 5, muted;
  ENSP ID: ENSP00000445215
MSGGGTETPVGCEAAPGGGSKKRDSLGTAGSAHLIIKDLGEIHSRLLDHRPVIQGETRYFVKEFECKQLMTQSVDSNRGNRNEKRFIVTT

SEQ ID NO: 9145 - protein, 68 aa, Homo sapiens
  Payload ID: 1854;
  Gene Symbol: BLOC1S5;
  Gene Name: biogenesis of lysosomal organelles complex-1, subunit 5, muted;
  ENSP ID: ENSP00000486019
MSGGGTETPVGCEAAPGGGSKKRDSLGTAGSAHLIIKDLGEIHSRLLDHRPVIQGETRYFVKEFENED

SEQ ID NO: 9146 - protein, 172 aa, Homo sapiens
  Payload ID: 1855;
  Gene Symbol: BLOC1S6;
  Gene Name: biogenesis of lysosomal organelles complex-1, subunit 6, pallidin;
  Uniprot ID:  Q9UL45;
  ENSP ID: ENSP00000220531
MSVPGPSSPDGALTRPPYCLEAGEPTPGLSDTSPDEGLIEDLTIEDKAVEQLAEGLLSHYLPDLQRSKQALQELTQNQVVLLDTLEQEISKFKECHSMLDINALFAEAKHYHAKLVNIRKEMLMLHEKTSKLKKRALKLQQKRQKEELEREQQREKEFEREKQLTARPAKRM

SEQ ID NO: 9147 - protein, 43 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000454438
MSVPGPSSPDGALTRPPYCLEAGEPTPEPSCIVRHTGTRDFKI

SEQ ID NO: 9148 - protein, 46 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000454537
MLDINALKRALKLQQKRQKEELEREQQREKEFEREKQLTARPAKRM

SEQ ID NO: 9149 - protein, 86 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000454638
MSVPGPSSPDGALTRPPYCLEAGEPTPGLSDTSPDEGLIEDLTIEDKAVEQLAEGLLSHYLPDLQRSKQALQELTLLRLNTIMPSW

SEQ ID NO: 9150 - protein, 21 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000454715
MLDINALFAEAKHYHAKLVNI

SEQ ID NO: 9151 - protein, 113 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000454803
MQKSSIKYWQTESSSTSKSLSTMIKQNQVVLLDTLEQEISKFKECHSMLDINALFAEAKHYHAKLVNIRKEMLMLHEKTSKLKKRALKLQQKRQKEELEREQQREKEFEREKQ

SEQ ID NO: 9152 - protein, 75 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000455021
MLDINALFAEAKHYHAKLVNIRKEMLMLHEKTSKLKKRALKLQQKRQKEELEREQQREKEFEREKQLTARPAKRM

SEQ ID NO: 9153 - protein, 57 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000455439
  MOD_RES (1)..(1): Any amino acid
XLGTGLSDTSPDEGLIEDLTIEDKAVEQLAEGLLSHYLPDLQRSKQALQELTTKLYC

SEQ ID NO: 9154 - protein, 75 aa, Homo sapiens; identical to SEQ ID NO: 9152
  Payload ID: 1855;
  Gene Symbol: BLOC1S6;
  Gene Name: biogenesis of lysosomal organelles complex-1, subunit 6, pallidin;
  ENSP ID: ENSP00000455599

SEQ ID NO: 9155 - protein, 131 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000456067
MSVPGPSSPDGALTRPPYCLEAGEPTPAFFKIFRQNQVVLLDTLEQEISKFKECHSMLDINALFAEAKHYHAKLVNIRKEMLMLHEKTSKLKKRALKLQQKRQKEELEREQQREKEFEREKQLTARPAKRM

SEQ ID NO: 9156 - protein, 75 aa, Homo sapiens; identical to SEQ ID NO: 9152
  Payload ID: 1855;
  Gene Symbol: BLOC1S6;
  Gene Name: biogenesis of lysosomal organelles complex-1, subunit 6, pallidin;
  ENSP ID: ENSP00000456152

SEQ ID NO: 9157 - protein, 80 aa, Homo sapiens
  Payload ID: 1855;
  Gene Symbol: BLOC1S6;
  Gene Name: biogenesis of lysosomal organelles complex-1, subunit 6, pallidin;
  Uniprot ID:  Q9UL45;
  ENSP ID: ENSP00000456624
MSVPGPSSPDGALTRPPYCLEAGEPTPGLSDTSPDEGLIEDLTIEDKAVEQLAEGLLSHYLPDLQRSKQALQELTTKLYC

SEQ ID NO: 9158 - protein, 177 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000456851
MGGTEVPRGSFVLGVQLKAVDGEAILSLCVDSGLSDTSPDEGLIEDLTIEDKAVEQLAEGLLSHYLPDLQRSKQALQELTQNQVVLLDTLEQEISKFKECHSMLDINALFAEAKHYHAKLVNIRKEMLMLHEKTSKLKKRALKLQQKRQKEELEREQQREKEFEREKQLTARPAKRM

SEQ ID NO: 9159 - protein, 75 aa, Homo sapiens; identical to SEQ ID NO: 9152
  Payload ID: 1855;
  Gene Symbol: BLOC1S6;
  Gene Name: biogenesis of lysosomal organelles complex-1, subunit 6, pallidin;
  ENSP ID: ENSP00000457077

SEQ ID NO: 9160 - protein, 85 aa, Homo sapiens
  Payload ID: 1855;
  Gene Symbol: BLOC1S6;
  Gene Name: biogenesis of lysosomal organelles complex-1, subunit 6, pallidin;
  ENSP ID: ENSP00000457478
MSVPGPSSPDGALTRPPYCLEAGEPTPGLSDTSPDEGLIEDLTIEDKAVEQLAEGLLSHYLPDLQRSKQALQELTLDLKYDVEYP

SEQ ID NO: 9161 - protein, 129 aa, Homo sapiens
  Payload ID: 1856;
  Gene Symbol: BOD1;
  Gene Name: biorientation of chromosomes in cell division 1;
  Uniprot ID:  Q96IK1;
  ENSP ID: ENSP00000285908
MADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQIRQTPFES

SEQ ID NO: 9162 - protein, 185 aa, Homo sapiens
  Payload ID: 1856;
  Gene Symbol: BOD1;
  Gene Name: biorientation of chromosomes in cell division 1;
  Uniprot ID:  Q96IK1;
  ENSP ID: ENSP00000309644
MADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQSGMLEAGVDRIISQVVDPKLNHIFRPQIERAIHEFLAAQKKAAVPAPPPEPEGQDPPAPSQDTS

SEQ ID NO: 9163 - protein, 41 aa, Homo sapiens
  Payload ID: 1856;
  Gene Symbol: BOD1;
  Gene Name: biorientation of chromosomes in cell division 1;
  ENSP ID: ENSP00000417641
MNKNQLRNGLRQSVVQSGMLEAGVDRIISQVVDPKLNHIFR

SEQ ID NO: 9164 - protein, 118 aa, Homo sapiens
  Payload ID: 1856;
  Gene Symbol: BOD1;
  Gene Name: biorientation of chromosomes in cell division 1;
  ENSP ID: ENSP00000420005
  MOD_RES (1)..(1): Any amino acid
XLALLGPAGAVAPSTRPRCLPATRSSSLSSWSSSRAGAFLTASAGTAWPTWTPRSGMLEAGVDRIISQVVDPKLNHIFRPQIERAIHEFLAAQKKAAVPAPPPEPEGQDPPAPSQDTS

SEQ ID NO: 9165 - protein, 85 aa, Homo sapiens
  Payload ID: 1856;
  Gene Symbol: BOD1;
  Gene Name: biorientation of chromosomes in cell division 1;
  ENSP ID: ENSP00000420337
MADGGGGGGTGAVGGGGTSQASAGAATGATGASGGGGPINPASLPPGDPQLIALIVEQLKSRGLFDSFRRDCLADVDTKNTPDTF

SEQ ID NO: 9166 - protein, 3051 aa, Homo sapiens
  Payload ID: 1857;
  Gene Symbol: BOD1L1;
  Gene Name: biorientation of chromosomes in cell division 1-like 1;
  Uniprot ID:  Q8NFC6;
  ENSP ID: ENSP00000040738
MATNPQPQPPPPAPPPPPPQPQPQPPPPPPGPGAGPGAGGAGGAGAGAGDPQLVAMIVNHLKSQGLFDQFRRDCLADVDTKPAYQNLRQRVDNFVANHLATHTWSPHLNKNQLRNNIRQQVLKSGMLESGIDRIISQVVDPKINHTFRPQVEKAVHEFLATLNHKEEGSGNTAPDDEKPDTSLITQGVPTPGPSANVANDAMSILETITSLNQEASAARASTETSNAKTSERASKKLPSQPTTDTSTDKERTSEDMADKEKSTADSGGEGLETAPKSEEFSDLPCPVEEIKNYTKEHNNLILLNKDVQQESSEQKNKSTDKGEKKPDSNEKGERKKEKKEKTEKKFDHSKKSEDTQKVKDEKQAKEKEVESLKLPSEKNSNKAKTVEGTKEDFSLIDSDVDGLTDITVSSVHTSDLSSFEEDTEEEVVTSDSMEEGEITSDDEEKNKQNKTKTQTSDSSEGKTKSVRHAYVHKPYLYSKYYSDSDDELTVEQRRQSIAKEKEERLLRRQINREKLEEKRKQKAEKTKSSKTKGQGRSSVDLEESSTKSLEPKAARIKEVLKERKVLEKKVALSKKRKKDSRNVEENSKKKQQYEEDSKETLKTSEHCEKEKISSSKELKHVHAKSEPSKPARRLSESLHVVDENKNESKLEREHKRRTSTPVIMEGVQEETDTRDVKRQVERSEICTEEPQKQKSTLKNEKHLKKDDSETPHLKSLLKKEVKSSKEKPEREKTPSEDKLSVKHKYKGDCMHKTGDETELHSSEKGLKVEENIQKQSQQTKLSSDDKTERKSKHRNERKLSVLGKDGKPVSEYIIKTDENVRKENNKKERRLSAEKTKAEHKSRRSSDSKIQKDSLGSKQHGITLQRRSESYSEDKCDMDSTNMDSNLKPEEVVHKEKRRTKSLLEEKLVLKSKSKTQGKQVKVVETELQEGATKQATTPKPDKEKNTEENDSEKQRKSKVEDKPFEETGVEPVLETASSSAHSTQKDSSHRAKLPLAKEKYKSDKDSTSTRLERKLSDGHKSRSLKHSSKDIKKKDENKSDDKDGKEVDSSHEKARGNSSLMEKKLSRRLCENRRGSLSQEMAKGEEKLAANTLSTPSGSSLQRPKKSGDMTLIPEQEPMEIDSEPGVENVFEVSKTQDNRNNNSQQDIDSENMKQKTSATVQKDELRTCTADSKATAPAYKPGRGTGVNSNSEKHADHRSTLTKKMHIQSAVSKMNPGEKEPIHRGTTEVNIDSETVHRMLLSAPSENDRVQKNLKNTAAEEHVAQGDATLEHSTNLDSSPSLSSVTVVPLRESYDPDVIPLFDKRTVLEGSTASTSPADHSALPNQSLTVRESEVLKTSDSKEGGEGFTVDTPAKASITSKRHIPEAHQATLLDGKQGKVIMPLGSKLTGVIVENENITKEGGLVDMAKKENDLNAEPNLKQTIKATVENGKKDGIAVDHVVGLNTEKYAETVKLKHKRSPGKVKDISIDVERRNENSEVDTSAGSGSAPSVLHQRNGQTEDVATGPRRAEKTSVATSTEGKDKDVTLSPVKAGPATTTSSETRQSEVALPCTSIEADEGLIIGTHSRNNPLHVGAEASECTVFAAAEEGGAVVTEGFAESETFLTSTKEGESGECAVAESEDRAADLLAVHAVKIEANVNSVVTEEKDDAVTSAGSEEKCDGSLSRDSEIVEGTITFISEVESDGAVTSAGTEIRAGSISSEEVDGSQGNMMRMGPKKETEGTVTCTGAEGRSDNFVICSVTGAGPREERMVTGAGVVLGDNDAPPGTSASQEGDGSVNDGTEGESAVTSTGITEDGEGPASCTGSEDSSEGFAISSESEENGESAMDSTVAKEGTNVPLVAAGPCDDEGIVTSTGAKEEDEEGEDVVTSTGRGNEIGHASTCTGLGEESEGVLICESAEGDSQIGTVVEHVEAEAGAAIMNANENNVDSMSGTEKGSKDTDICSSAKGIVESSVTSAVSGKDEVTPVPGGCEGPMTSAASDQSDSQLEKVEDTTISTGLVGGSYDVLVSGEVPECEVAHTSPSEKEDEDIITSVENEECDGLMATTASGDITNQNSLAGGKNQGKVLIISTSTTNDYTPQVSAITDVEGGLSDALRTEENMEGTRVTTEEFEAPMPSAVSGDDSQLTASRSEEKDECAMISTSIGEEFELPISSATTIKCAESLQPVAAAVEERATGPVLISTADFEGPMPSAPPEAESPLASTSKEEKDECALISTSIAEECEASVSGVVVESENERAGTVMEEKDGSGIISTSSVEDCEGPVSSAVPQEEGDPSVTPAEEMGDTAMISTSTSEGCEAVMIGAVLQDEDRLTITRVEDLSDAAIISTSTAECMPISASIDRHEENQLTADNPEGNGDLSATEVSKHKVPMPSLIAENNCRCPGPVRGGKEPGPVLAVSTEEGHNGPSVHKPSAGQGHPSAVCAEKEEKHGKECPEIGPFAGRGQKESTLHLINAEEKNVLLNSLQKEDKSPETGTAGGSSTASYSAGRGLEGNANSPAHLRGPEQTSGQTAKDPSVSIRYLAAVNTGAIKADDMPPVQGTVAEHSFLPAEQQGSEDNLKTSTTKCITGQESKIAPSHTMIPPATYSVALLAPKCEQDLTIKNDYSGKWTDQASAEKTGDDNSTRKSFPEEGDIMVTVSSEENVCDIGNEESPLNVLGGLKLKANLKMEAYVPSEEEKNGEILAPPESLCGGKPSGIAELQREPLLVNESLNVENSGFRTNEEIHSESYNKGEISSGRKDNAEAISGHSVEADPKEVEEEERHMPKRKRKQHYLSSEDEPDDNPDVLDSRIETAQRQCPETEPHDTKEENSRDLEELPKTSSETNSTTSRVMEEKDEYSSSETTGEKPEQNDDDTIKSQEEDQPIIIKRKRGRPRKYPVETTLKMKDDSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRSKTQLSPSIKRKREVSPPGARTRGQQRVEEAPVKKAKR

SEQ ID NO: 9167 - protein, 93 aa, Homo sapiens
  Payload ID: 1857;
  Gene Symbol: BOD1L1;
  Gene Name: biorientation of chromosomes in cell division 1-like 1;
  ENSP ID: ENSP00000420541
MATNPQPQPPPPAPPPPPPQPQPQPPPPPPGPGAGPGAGGAGGAGAGAGDPQLVAMIVNHLKSQGLFDQFRRDCLADVDTKSLALSPGWNAMA

SEQ ID NO: 9168 - protein, 207 aa, Homo sapiens
  Payload ID: 1857;
  Gene Symbol: BOD1L1;
  Gene Name: biorientation of chromosomes in cell division 1-like 1;
  ENSP ID: ENSP00000425492
  MOD_RES (1)..(1): Any amino acid
XSKTDTGIVTVEQSPSSSKLKVMQTDESNKETANLQERSISNDDGEEKIVTSVRRRGRKPKRSLTVSDDAESSEPERKRQKSVSDPVEDKKEQESDEEEEEEEEDEPSGATTRSTTRSEAQRKQHSKPSARATSKLGSPDTVSPRNRQKLAKEKLPTSEKVSNSPPLGRSKTQLSPSIKRKREVSPPGARTRGQQRVEEAPVKKAKR

SEQ ID NO: 9169 - protein, 172 aa, Homo sapiens
  Payload ID: 1858;
  Gene Symbol: BOD1L2;
  Gene Name: biorientation of chromosomes in cell division 1-like 2;
  Uniprot ID:  Q8IYS8;
  ENSP ID: ENSP00000467843
MADGGGGGSGGAGPASTRASGGGGPINPASLPPGDPQLIAIIVGQLKSRGLFDSFRRDCKADVDTKPAYQNLSQKADNFVSTHLDKQEWNPPANDNQLHDGLRQSVVQSGRSEAGVDRISSQVVDPKLNHIFRPQIEQIIHEFLVAQKEAAVPALPPEPEGQDPPAPSQDTS

SEQ ID NO: 9170 - protein, 543 aa, Homo sapiens
  Payload ID: 1859;
  Gene Symbol: BTD;
  Gene Name: biotinidase;
  Uniprot ID:  P43251;
  ENSP ID: ENSP00000306477
MAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 9171 - protein, 523 aa, Homo sapiens
  Payload ID: 1859;
  Gene Symbol: BTD;
  Gene Name: biotinidase;
  Uniprot ID:  P43251;
  ENSP ID: ENSP00000373288
MSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 9172 - protein, 545 aa, Homo sapiens
  Payload ID: 1859;
  Gene Symbol: BTD;
  Gene Name: biotinidase;
  Uniprot ID:  P43251;
  ENSP ID: ENSP00000388212
MPEGGGTSRRLLPMQSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 9173 - protein, 251 aa, Homo sapiens
  Payload ID: 1859;
  Gene Symbol: BTD;
  Gene Name: biotinidase;
  ENSP ID: ENSP00000394277
MSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTA

SEQ ID NO: 9174 - protein, 58 aa, Homo sapiens
  Payload ID: 1859;
  Gene Symbol: BTD;
  Gene Name: biotinidase;
  ENSP ID: ENSP00000397113
MSGARSKLALFLCGCYVVALGAHTGEESVADHHEAEYYVAAVYEHPSILSLNPLALIS

SEQ ID NO: 9175 - protein, 545 aa, Homo sapiens
  Payload ID: 1859;
  Gene Symbol: BTD;
  Gene Name: biotinidase;
  Uniprot ID:  P43251;
  ENSP ID: ENSP00000400995
MARKETQLIIKMNHLARFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 9176 - protein, 64 aa, Homo sapiens [sequence omitted]

SEQ ID NO: 9177 - protein, 194 aa, Homo sapiens
  Payload ID: 1860;
  Gene Symbol: BPHL;
  Gene Name: biphenyl hydrolase-like (serine hydrolase);
  ENSP ID: ENSP00000369726
MPRNLLYSLLSSHLSPHFSTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGWSLTLSPGWNAMA

SEQ ID NO: 9178 - protein, 274 aa, Homo sapiens
  Payload ID: 1860;
  Gene Symbol: BPHL;
  Gene Name: biphenyl hydrolase-like (serine hydrolase);
  Uniprot ID:  Q86WA6;
  ENSP ID: ENSP00000369734
MPRNLLYSLLSSHLSPHFSTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 9179 - protein, 291 aa, Homo sapiens
  Payload ID: 1860;
  Gene Symbol: BPHL;
  Gene Name: biphenyl hydrolase-like (serine hydrolase);
  Uniprot ID:  Q86WA6;
  ENSP ID: ENSP00000369739
MVAVLGGRGVLRLRLLLSALKPGIHVPRAGPAAAFGTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 9180 - protein, 274 aa, Homo sapiens; identical to SEQ ID NO: 9178
  Payload ID: 1860;
  Gene Symbol: BPHL;
  Gene Name: biphenyl hydrolase-like (serine hydrolase);
  Uniprot ID:  Q86WA6;
  ENSP ID: ENSP00000390472

SEQ ID NO: 9181 - protein, 44 aa, Homo sapiens
  Payload ID: 1860;
  Gene Symbol: BPHL;
  Gene Name: biphenyl hydrolase-like (serine hydrolase);
  ENSP ID: ENSP00000394072
MVAVLGGRGVLRLRLLLSALKPGIHVPRAGPAAAFGNQPEPEYR

SEQ ID NO: 9182 - protein, 29 aa, Homo sapiens
  Payload ID: 1860;
  Gene Symbol: BPHL;
  Gene Name: biphenyl hydrolase-like (serine hydrolase);
  ENSP ID: ENSP00000395744
  MOD_RES (1)..(1): Any amino acid
XALIVHGEKDPLVPRFHADFIHKHVKGSR

SEQ ID NO: 9183 - protein, 44 aa, Homo sapiens; identical to SEQ ID NO: 9181
  Payload ID: 1860;
  Gene Symbol: BPHL;
  Gene Name: biphenyl hydrolase-like (serine hydrolase);
  ENSP ID: ENSP00000396637

SEQ ID NO: 9184 - protein, 211 aa, Homo sapiens
  Payload ID: 1860;
  Gene Symbol: BPHL;
  Gene Name: biphenyl hydrolase-like (serine hydrolase);
  ENSP ID: ENSP00000413762
MVAVLGGRGVLRLRLLLSALKPGIHVPRAGPAAAFGTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGWSLTLSPGWNAMA

SEQ ID NO: 9185 - protein, 1385 aa, Homo sapiens
  Payload ID: 1861;
  Gene Symbol: BIVM-ERCC5;
  Gene Name: BIVM-ERCC5 readthrough;
  ENSP ID: ENSP00000473384
  MOD_RES (1)..(1): Any amino acid
XQGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKGRYQKECPQHSPLEDIKQRKVLDLRRWYCISRPQYKTSCGISSLISCWNFLYSTMGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKVGGNLHCIIAFQRLNWQRFGLWNFPFGTIRQESQPPTHAQGIAKSESEDNISKKQHGRLGRSFSASFHQDSAWKKMSNISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIR

SEQ ID NO: 9186 - protein, 87 aa, Homo sapiens
  Payload ID: 1862;
  Gene Symbol: BLCAP;
  Gene Name: bladder cancer associated prt;
  Uniprot ID:  P62952;
  ENSP ID: ENSP00000362637
MYCLQWLLPVLLIPKPLNPALWFSHSMFMGFYLLSFLLERKPCTICALVFLAALFLICYSCWGNCFLYHCSDSPLPESAHDPGVVGT

SEQ ID NO: 9187 - protein, 87 aa, Homo sapiens; identical to SEQ ID NO: 9186
  Payload ID: 1862;
  Gene Symbol: BLCAP;
  Gene Name: bladder cancer associated prt;
  Uniprot ID:  P62952;
  ENSP ID: ENSP00000380320

SEQ ID NO: 9188 - protein, 87 aa, Homo sapiens; identical to SEQ ID NO: 9186
  Payload ID: 1862;
  Gene Symbol: BLCAP;
  Gene Name: bladder cancer associated prt;
  Uniprot ID:  P62952;
  ENSP ID: ENSP00000380323

SEQ ID NO: 9189 - protein, 87 aa, Homo sapiens; identical to SEQ ID NO: 9186
  Payload ID: 1862;
  Gene Symbol: BLCAP;
  Gene Name: bladder cancer associated prt;
  Uniprot ID:  P62952;
  ENSP ID: ENSP00000380324

SEQ ID NO: 9190 - protein, 87 aa, Homo sapiens; identical to SEQ ID NO: 9186
  Payload ID: 1862;
  Gene Symbol: BLCAP;
  Gene Name: bladder cancer associated prt;
  Uniprot ID:  P62952;
  ENSP ID: ENSP00000380326

SEQ ID NO: 9191 - protein, 7 aa, Homo sapiens
  Payload ID: 1862;
  Gene Symbol: BLCAP;
  Gene Name: bladder cancer associated prt;
  ENSP ID: ENSP00000389735
MYCLQWL

SEQ ID NO: 9192 - protein, 62 aa, Homo sapiens
  Payload ID: 1862;
  Gene Symbol: BLCAP;
  Gene Name: bladder cancer associated prt;
  ENSP ID: ENSP00000391768
MYCLQWLLPVLLIPKPLNPALWFSHSMFMGFYLLSFLLERKPCTICALVFLAALFLICYSCW

SEQ ID NO: 9193 - protein, 87 aa, Homo sapiens; identical to SEQ ID NO: 9186
  Payload ID: 1862;
  Gene Symbol: BLCAP;
  Gene Name: bladder cancer associated prt;
  Uniprot ID:  P62952;
  ENSP ID: ENSP00000397172

SEQ ID NO: 9194 - protein, 78 aa, Homo sapiens
  Payload ID: 1862;
  Gene Symbol: BLCAP;
  Gene Name: bladder cancer associated prt;
  ENSP ID: ENSP00000405953
MYCLQWLLPVLLIPKPLNPALWFSHSMFMGFYLLSFLLERKPCTICALVFLAALFLICYSCWGNCFLYHCSDSPLPES

SEQ ID NO: 9195 - protein, 87 aa, Homo sapiens; identical to SEQ ID NO: 9186
  Payload ID: 1862;
  Gene Symbol: BLCAP;
  Gene Name: bladder cancer associated prt;
  Uniprot ID:  P62952;
  ENSP ID: ENSP00000414973

SEQ ID NO: 9196 - protein, 455 aa, Homo sapiens
  Payload ID: 1863;
  Gene Symbol: BLMH;
  Gene Name: bleomycin hydrolase;
  Uniprot ID:  Q13867;
  ENSP ID: ENSP00000261714
MSSSGLNSEKVAALIQKLNSDPQFVLAQNVGTTHDLLDICLKRATVQRAQHVFQHAVPQEGKPITNQKSSGRCWIFSCLNVMRLPFMKKLNIEEFEFSQSYLFFWDKVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 9197 - protein, 71 aa, Homo sapiens
  Payload ID: 1863;
  Gene Symbol: BLMH;
  Gene Name: bleomycin hydrolase;
  ENSP ID: ENSP00000462353
MSSSGLNSEKVAALIQKLNSDPQFVLAQNVGTTHDLLDICLKRATVQRAQHVFQHAVPQEGKPITNQKSSG

SEQ ID NO: 9198 - protein, 262 aa, Homo sapiens
  Payload ID: 1863;
  Gene Symbol: BLMH;
  Gene Name: bleomycin hydrolase;
  ENSP ID: ENSP00000462442
VDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKVVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEK

SEQ ID NO: 9199 - protein, 67 aa, Homo sapiens
  Payload ID: 1863;
  Gene Symbol: BLMH;
  Gene Name: bleomycin hydrolase;
  ENSP ID: ENSP00000466527
MRLPFMKKLNIEEFEFSQSYLFFWDKVERCYFFLSAFVDTAQRKEPEDGRLVQFLLMNPANDGGQWD

SEQ ID NO: 9200 - protein, 93 aa, Homo sapiens
  Payload ID: 1863;
  Gene Symbol: BLMH;
  Gene Name: bleomycin hydrolase;
  ENSP ID: ENSP00000466948
MSSSGLNSEKVAALIQKLNSDPQFVLAQNVGTTHDLLDICLKRATVQRAQHVFQHAVPQEGKPITNQKSSGVGFHFSHTFLDLPDSVPFWCLI

SEQ ID NO: 9201 - protein, 318 aa, Homo sapiens
  Payload ID: 1863;
  Gene Symbol: BLMH;
  Gene Name: bleomycin hydrolase;
  ENSP ID: ENSP00000468486
MRLRRLNSEKVAALIQKLNSDPQFVLAQNVGTTHDLLDICLKRATVQRAQHVFQHAVPQEGKPITNQKSSGRCWIFSCLNVMRLPFMKKLNIEEFEFSQSYLFFWDKVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKVVNDPRPQHKYNKLYTVEYLSNMVGGRKTLYNNQPIDFLKKMVAASIKDGE

SEQ ID NO: 9202 - protein, 231 aa, Homo sapiens
  Payload ID: 1863;
  Gene Symbol: BLMH;
  Gene Name: bleomycin hydrolase;
  ENSP ID: ENSP00000468681
MNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGE

SEQ ID NO: 9203 - protein, 505 aa, Homo sapiens
  Payload ID: 1864;
  Gene Symbol: BLK;
  Gene Name: BLK proto-oncogene, Src family tyr kinase;
  Uniprot ID:  P51451;
  ENSP ID: ENSP00000259089
MGLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 9204 - protein, 434 aa, Homo sapiens
  Payload ID: 1864;
  Gene Symbol: BLK;
  Gene Name: BLK proto-oncogene, Src family tyr kinase;
  ENSP ID: ENSP00000433663
MNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANVMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 9205 - protein, 148 aa, Homo sapiens
  Payload ID: 1865;
  Gene Symbol: BORCS5;
  Gene Name: BLOC-1 related complex subunit 5;
  Uniprot ID:  Q969J3;
  ENSP ID: ENSP00000298571
MGSEQSSEAESRPNDLNSSGLLSGQTSPTNAKLEKLDSQQVLQLCLRYQDHLHQCAEAVAFDQNALVKRIKEMDLSVETLFSFMQERQKRYAKYAEQIQKVNEMSAILRRIQMGIDQTVPLLDRLNSMLPEGERLEPFSMKPDRELRL

SEQ ID NO: 9206 - protein, 196 aa, Homo sapiens
  Payload ID: 1865;
  Gene Symbol: BORCS5;
  Gene Name: BLOC-1 related complex subunit 5;
  Uniprot ID:  Q969J3;
  ENSP ID: ENSP00000321546
MGSEQSSEAESRPNDLNSSVTPSPAKHRAKMDDIVVVAQGSQASRNVSNDPDVIKLQEIPTFQPLLKGLLSGQTSPTNAKLEKLDSQQVLQLCLRYQDHLHQCAEAVAFDQNALVKRIKEMDLSVETLFSFMQERQKRYAKYAEQIQKVNEMSAILRRIQMGIDQTVPLLDRLNSMLPEGERLEPFSMKPDRELRL

SEQ ID NO: 9207 - protein, 177 aa, Homo sapiens
  Payload ID: 1865;
  Gene Symbol: BORCS5;
  Gene Name: BLOC-1 related complex subunit 5;
  ENSP ID: ENSP00000443023
MTPSPAKHRAKMDDIVVVAQGSQASRNVSNDPDVIKLQEIPTFQPLLKGLLSGQTSPTNAKLEKLDSQQVLQLCLRYQDHLHQCAEAVAFDQNALVKRIKEMDLSVETLFSFMQERQKRYAKYAEQIQKVNEMSAILRRIQMGIDQTVPLLDRLNSMLPEGERLEPFSMKPDRELRL

SEQ ID NO: 9208 - protein, 177 aa, Homo sapiens; identical to SEQ ID NO: 9207
  Payload ID: 1865;
  Gene Symbol: BORCS5;
  Gene Name: BLOC-1 related complex subunit 5;
  ENSP ID: ENSP00000485829

SEQ ID NO: 9209 - protein, 196 aa, Homo sapiens; identical to SEQ ID NO: 9206
  Payload ID: 1865;
  Gene Symbol: BORCS5;
  Gene Name: BLOC-1 related complex subunit 5;
  ENSP ID: ENSP00000486120

SEQ ID NO: 9210 - protein, 148 aa, Homo sapiens; identical to SEQ ID NO: 9205
  Payload ID: 1865;
  Gene Symbol: BORCS5;
  Gene Name: BLOC-1 related complex subunit 5;
  ENSP ID: ENSP00000486584

SEQ ID NO: 9211 - protein, 357 aa, Homo sapiens
  Payload ID: 1866;
  Gene Symbol: BORCS6;
  Gene Name: BLOC-1 related complex subunit 6;
  Uniprot ID:  Q96GS4;
  ENSP ID: ENSP00000373669
MESSRGRPGPETDLLAVAEHQALVFGGGPGRTSSEPPAGLRVSGEEETENVGGANRHPRTSPKTSSCGVVHRPEREALENEPGPQGTLSGAGSRRGAPGAEHEPSLSSRHKNPAPPEGKPSSGRDCRRGGPGGGMDVEQQEEEDNDEEAAAGSRAGRSFSSRLQDSRSLDGLSEACGGAGSSGSAESGAGGGRRATISSPLELEGTVSRHGDLTHFVANNLQLKIRLSGAPPPPPSAPARPCPAPAPTPTPAIPPIDPEVLRDLERLSRELGGRVDRLLRGLGGAVQELTALSVGCIQTYRDAVDSLGEAVDMSIKGMYTLLARCEELERALQPVQGLARQVRDIRRTLEVLEALCK

SEQ ID NO: 9212 - protein, 106 aa, Homo sapiens
  Payload ID: 1867;
  Gene Symbol: BORCS7;
  Gene Name: BLOC-1 related complex subunit 7;
  Uniprot ID:  Q96B45;
  ENSP ID: ENSP00000342331
MMATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 9213 - protein, 106 aa, Homo sapiens; identical to SEQ ID NO: 9212
  Payload ID: 1867;
  Gene Symbol: BORCS7;
  Gene Name: BLOC-1 related complex subunit 7;
  Uniprot ID:  Q96B45;
  ENSP ID: ENSP00000358899

SEQ ID NO: 9214 - protein, 109 aa, Homo sapiens
  Payload ID: 1868;
  Gene Symbol: BORCS8;
  Gene Name: BLOC-1 related complex subunit 8;
  Uniprot ID:  Q96FH0;
  ENSP ID: ENSP00000424833
MEEPEMQLKGKKVTDKFTESVYVLANEPSVALYRLQEHVRRSLPELAQHKADMQRWEEQSQGAIYTVEYACSAVKNLVDSSVYFRSVEGLLKQAISIRDHMNASAQGHR

SEQ ID NO: 9215 - protein, 119 aa, Homo sapiens
  Payload ID: 1868;
  Gene Symbol: BORCS8;
  Gene Name: BLOC-1 related complex subunit 8;
  Uniprot ID:  Q96FH0;
  ENSP ID: ENSP00000425864
MEEPEMQLKGKKVTDKFTESVYVLANEPSVALYRLQEHVRRSLPELAQHKADMQRWEEQSQGAIYTVEYACSAVKNLVDSSVYFRSVEGLLKQAISIRDHMNASAQGHSPEEPPPPSSA

SEQ ID NO: 9216 - protein, 69 aa, Homo sapiens
  Payload ID: 1868;
  Gene Symbol: BORCS8;
  Gene Name: BLOC-1 related complex subunit 8;
  ENSP ID: ENSP00000467140
ADMQRWEEQSQGAIYTVEYACSAVKNLVDSSVYFRSVEGLLKQAISIRDHMNASAQGHSPEEPPPPSSA

SEQ ID NO: 9217 - protein, 119 aa, Homo sapiens; identical to SEQ ID NO: 9215
  Payload ID: 1868;
  Gene Symbol: BORCS8;
  Gene Name: BLOC-1 related complex subunit 8;
  Uniprot ID:  Q96FH0;
  ENSP ID: ENSP00000467744

SEQ ID NO: 9218 - protein, 62 aa, Homo sapiens
  Payload ID: 1868;
  Gene Symbol: BORCS8;
  Gene Name: BLOC-1 related complex subunit 8;
  ENSP ID: ENSP00000475370
MPVPRATARRNHPRPPQPDPGRDSGPPSLRQPRDGVSPCWLGWSQTPELVILPPQPPKVLGL

SEQ ID NO: 9219 - protein, 136 aa, Homo sapiens
  Payload ID: 1869;
  Gene Symbol: BLOC1S5-TXNDC5;
  Gene Name: BLOC1S5-TXNDC5 readthrough (NMD candidate);
  ENSP ID: ENSP00000454697
GTETPVGCEAAPGGGSKKRDSLGTAGSAHLIIKDLGEIHSRLLDHRPVIQGETRYFVKEFEEKRGLREMRVLENLKNMIHETNEHTLPKCRDTMRDSLSQVLQRLQAANDSVCRLQQREQERKKVWTLPAAAADLE

SEQ ID NO: 9220 - protein, 746 aa, Homo sapiens
  Payload ID: 1870;
  Gene Symbol: BOP1;
  Gene Name: block of proliferation 1;
  Uniprot ID:  Q14137;
  ENSP ID: ENSP00000455106
MAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSDDGSLRLWEVATARCVRTVPVGGVVKSVAWNPSPAVCLVAAAVEDSVLLLNPALGDRLVAGSTDQLLSAFVPPEEPPLQPARWLEASEEERQVGLRLRICHGKPVTQVTWHGRGDYLAVVLATQGHTQVLIHQLSRRRSQSPFRRSHGQVQRVAFHPARPFLLVASQRSVRLYHLLRQELTKKLMPNCKWVSSLAVHPAGDNVICGSYDSKLVWFDLDLSTKPYRMLRHHKKALRAVAFHPRYPLFASGSDDGSVIVCHGMVYNDLLQNPLLVPVKVLKGHVLTRDLGVLDVIFHPTQPWVFSSGADGTVRLFT

SEQ ID NO: 9221 - protein, 217 aa, Homo sapiens
  Payload ID: 1870;
  Gene Symbol: BOP1;
  Gene Name: block of proliferation 1;
  ENSP ID: ENSP00000456082
MAGSRGAGRTAAPSVRPEKRRSEPELEPEPEPEASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQE

SEQ ID NO: 9222 - protein, 360 aa, Homo sapiens
  Payload ID: 1871;
  Gene Symbol: BVES;
  Gene Name: blood vessel epicardial substance;
  Uniprot ID:  Q8NE79;
  ENSP ID: ENSP00000313172
MNYTESSPLRESTAIGFTPELESIIPVPSNKTTCENWREIHHLVFHVANICFAVGLVIPTTLHLHMIFLRGMLTLGCTLYIVWATLYRCALDIMIWNSVFLGVNILHLSYLLYKKRPVKIEKELSGMYRRLFEPLRVPPDLFRRLTGQFCMIQTLKKGQTYAAEDKTSVDDRLSILLKGKMKVSYRGHFLHNIYPCAFIDSPEFRSTQMHKGEKFQVTIIADDNCRFLCWSRERLTYFLESEPFLYEIFRYLIGKDITNKLYSLNDPTLNDKKAKKLEHQLSLCTQISMLEMRNSIASSSDSDDGLHQFLRGTSSMSSLHVSSPHQRASAKMKPIEEGAEDDDDVFEPASPNTLKVHQLP

SEQ ID NO: 9223 - protein, 360 aa, Homo sapiens; identical to SEQ ID NO: 9222
  Payload ID: 1871;
  Gene Symbol: BVES;
  Gene Name: blood vessel epicardial substance;
  Uniprot ID:  Q8NE79;
  ENSP ID: ENSP00000337259

SEQ ID NO: 9224 - protein, 360 aa, Homo sapiens; identical to SEQ ID NO: 9222
  Payload ID: 1871;
  Gene Symbol: BVES;
  Gene Name: blood vessel epicardial substance;
  Uniprot ID:  Q8NE79;
  ENSP ID: ENSP00000397310

SEQ ID NO: 9225 - protein, 1417 aa, Homo sapiens
  Payload ID: 1872;
  Gene Symbol: BLM;
  Gene Name: Bloom syndrome, RecQ helicase-like;
  Uniprot ID:  P54132;
  ENSP ID: ENSP00000347232
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 9226 - protein, 413 aa, Homo sapiens
  Payload ID: 1872;
  Gene Symbol: BLM;
  Gene Name: Bloom syndrome, RecQ helicase-like;
  ENSP ID: ENSP00000453359
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDGSHCVAQAGLELLDLSNPPALASPKGWDYSHEPPCLAKTFFFFPQRKILTT

SEQ ID NO: 9227 - protein, 1286 aa, Homo sapiens
  Payload ID: 1872;
  Gene Symbol: BLM;
  Gene Name: Bloom syndrome, RecQ helicase-like;
  ENSP ID: ENSP00000454158
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 9228 - protein, 326 aa, Homo sapiens
  Payload ID: 1873;
  Gene Symbol: BMI1;
  Gene Name: BMI1 proto-oncogene, polycomb ring finger;
  Uniprot ID:  P35226;
  ENSP ID: ENSP00000365851
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPVQSPHPQFPHISSTMNGTSNSPSGNHQSSFANRPRKSSVNGSSATSSG

SEQ ID NO: 9229 - protein, 184 aa, Homo sapiens
  Payload ID: 1873;
  Gene Symbol: BMI1;
  Gene Name: BMI1 proto-oncogene, polycomb ring finger;
  ENSP ID: ENSP00000390768
YFIDATTIIECLHSFCKTCIVRYLETSKYCPICDVQVHKTRPLLNIRLDRKVNKDKEKSKEEVNDKRYLRCPAAMTVMHLRKFLRSKMDIPNTFQIDVMYEEEPLKDYYTLMDIAYIYTWRRNGPLPLKYRVRPTCKRMKISHQRDGLTNAGELESDSGSDKANSPAGGIPSTSSCLPSPSTPV

SEQ ID NO: 9230 - protein, 150 aa, Homo sapiens
  Payload ID: 1873;
  Gene Symbol: BMI1;
  Gene Name: BMI1 proto-oncogene, polycomb ring finger;
  ENSP ID: ENSP00000397912
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSADAANGSNEDRGEVADEDKRIITDDEIISLSIEFFDQNRLDRKVNKD

SEQ ID NO: 9231 - protein, 105 aa, Homo sapiens
  Payload ID: 1873;
  Gene Symbol: BMI1;
  Gene Name: BMI1 proto-oncogene, polycomb ring finger;
  ENSP ID: ENSP00000399220
MHRTTRIKITELNPHLMCVLCGGYFIDATTIIECLHSFCKTCIVRYLETSKYCPICDVQVHKTRPLLNIRSDKTLQDIVYKLVPGLFKNEMKRRRDFYAAHPSAD

SEQ ID NO: 9232 - protein, 260 aa, Homo sapiens
  Payload ID: 1874;
  Gene Symbol: BAMBI;
  Gene Name: BMP and activin membrane-bound inhibitor;
  Uniprot ID:  Q13145;
  ENSP ID: ENSP00000364683
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 9233 - protein, 685 aa, Homo sapiens
  Payload ID: 1875;
  Gene Symbol: BMPER;
  Gene Name: BMP binding endothelial regulator;
  Uniprot ID:  Q8N8U9;
  ENSP ID: ENSP00000297161
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKGCTYEGNTYNSSFKWQSPAEPCVLRQCQEGVVTESGVRCVVHCKNPLEHLGMCCPTCPGCVFEGVQYQEGEEFQPEGSKCTKCSCTGGRTQCVREVCPILSCPQHLSHIPPGQCCPKCLGQRKVFDLPFGSCLFRSDVYDNGSSFLYDNCTACTCRDSTVVCKRKCSHPGGCDQGQEGCCEECLLRVPPEDIKVCKFGNKIFQDGEMWSSINCTICACVKGRTECRNKQCIPISSCPQGKILNRKGCCPICTEKPGVCTVFGDPHYNTFDGRTFNFQGTCQYVLTKDCSSPASPFQVLVKNDARRTRSFSWTKSVELVLGESRVSLQQHLTVRWNGSRIALPCRAPHFHIDLDGYLLKVTTKAGLEISWDGDSFVEVMAAPHLKGKLCGLCGNYNGHKRDDLIGGDGNFKFDVDDFAESWRVESNEFCNRPQRKPVPELCQGTVKVKLRAHRECQKLKSWEFQTCHSTVDYATFYRSCVTDMCECPVHKNCYCESFLAYTRACQREGIKVHWEPQQNCAATQCKHGAVYDTCGPGCIKTCDNWNEIGPCNKPCVAGCHCPANLVLHKGRCIKPVLCPQR

SEQ ID NO: 9234 - protein, 90 aa, Homo sapiens
  Payload ID: 1875;
  Gene Symbol: BMPER;
  Gene Name: BMP binding endothelial regulator;
  ENSP ID: ENSP00000398835
MLWFSGVGALAERYCRRSPGITCCVLLLLNCSGVPMSLASSFLTGSVAKCENEGEVLQIPFITDNPCIMCVCLHEPTRWSNLTQNPGFYD

SEQ ID NO: 9235 - protein, 161 aa, Homo sapiens
  Payload ID: 1875;
  Gene Symbol: BMPER;
  Gene Name: BMP binding endothelial regulator;
  ENSP ID: ENSP00000399843
MLWFSGVGALAERYCRRSPGITCCVLLLLNCSGVPMSLASSFLTGSVAKCENEGEVLQIPFITDNPCIMCVCLVAPMKEIPITAPSNGRARLSLVFYASARRALSQSLGCAVLFIVKTLWSIWECAAPHVQAVCLRVCSIKKGRNFSQKEANVPSVPALEA

SEQ ID NO: 9236 - protein, 133 aa, Homo sapiens
  Payload ID: 1875;
  Gene Symbol: BMPER;
  Gene Name: BMP binding endothelial regulator;
  ENSP ID: ENSP00000409998
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKVLVSRVLRDTVLFTLKYWRLPVFWLHL

SEQ ID NO: 9237 - protein, 1161 aa, Homo sapiens
  Payload ID: 1876;
  Gene Symbol: BMP2K;
  Gene Name: BMP2 inducible kinase;
  Uniprot ID:  Q9NSY1;
  ENSP ID: ENSP00000334836
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 9238 - protein, 355 aa, Homo sapiens
  Payload ID: 1876;
  Gene Symbol: BMP2K;
  Gene Name: BMP2 inducible kinase;
  ENSP ID: ENSP00000373662
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINKCCKQLLRHGALLTEILLFLQLFLNR

SEQ ID NO: 9239 - protein, 662 aa, Homo sapiens
  Payload ID: 1876;
  Gene Symbol: BMP2K;
  Gene Name: BMP2 inducible kinase;
  Uniprot ID:  Q9NSY1;
  ENSP ID: ENSP00000421768
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSSKGHLKAYFASQ

SEQ ID NO: 9240 - protein, 854 aa, Homo sapiens
  Payload ID: 1876;
  Gene Symbol: BMP2K;
  Gene Name: BMP2 inducible kinase;
  ENSP ID: ENSP00000424668
  MOD_RES (1)..(1): Any amino acid
XFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 9241 - protein, 355 aa, Homo sapiens; identical to SEQ ID NO: 9238
  Payload ID: 1876;
  Gene Symbol: BMP2K;
  Gene Name: BMP2 inducible kinase;
  ENSP ID: ENSP00000487317

SEQ ID NO: 9242 - protein, 1282 aa, Homo sapiens
  Payload ID: 1877;
  Gene Symbol: BMS1;
  Gene Name: BMS1 ribosome biogenesis factor;
  Uniprot ID:  Q14692;
  ENSP ID: ENSP00000363642
MEAKDQKKHRKKNSGPKAAKKKKRLLQDLQLGDEEDARKRNPKAFAVQSAVRMARSFHRTQDLKTKKHHIPVVDRTPLEPPPIVVVVMGPPKVGKSTLIQCLIRNFTRQKLTEIRGPVTIVSGKKRRLTIIECGCDINMMIDLAKVADLVLMLIDASFGFEMETFEFLNICQVHGFPKIMGVLTHLDSFKHNKQLKKTKKRLKHRFWTEVYPGAKLFYLSGMVHGEYQNQEIHNLGRFITVMKFRPLTWQTSHPYILADRMEDLTNPEDIRTNIKCDRKVSLYGYLRGAHLKNKSQIHMPGVGDFAVSDISFLPDPCALPEQQKKRCLNEKEKLVYAPLSGVGGVLYDKDAVYVDLGGSHVFQDEVGPTHELVQSLISTHSTIDAKMASSRVTLFSDSKPLGSEDIDNQGLMMPKEEKQMDLNTGRMRRKAIFGDEDESGDSDDEEDDEMSEDDGLENGSSDEEAEEEENAEMTDQYMAVKGIKRRKLELEEDSEMDLPAFADSDDDLERSSAEEGEAEEADESSEEEDCTAGEKGISGSKAAGEGSKAGLSPANCQSDRVNLEKSLLMKKAALPTFDSGHCTAEEVFASEDESEESSSLSAEEEDSENEEAIRKKLSKPSQVSSGQKLGPQNFIDETSDIENLLKEEEDYKEENNDSKETSGALKWKEDLSRKAAEAFLRQQQAAPNLRKLIYGTVTEDNEEEDDDTLEELGGLFRVNQPDRECKHKADSLDCSRFLVEAPHDWDLEEVMNSIRDCFVTGKWEDDKDAAKVLAEDEELYGDFEDLETGDVHKGKSGPNTQNEDIEKEVKEEIDPDEEESAKKKHLDKKRKLKEMFDAEYDEGESTYFDDLKGEMQKQAQLNRAEFEDQDDEARVQYEGFRPGMYVRIEIENVPCEFVQNFDPHYPIILGGLGNSEGNVGYVQMRLKKHRWYKKILKSRDPIIFSVGWRRFQTIPLYYIEDHNGRQRLLKYTPQHMHCGAAFWGPITPQGTGFLAIQSVSGIMPDFRIAATGVVLDLDKSIKIVKKLKLTGFPYKIFKNTSFIKGMFNSALEVAKFEGAVIRTVSGIRGQIKKALRAPEGAFRASFEDKLLMSDIVFMRTWYPVSIPAFYNPVTSLLKPVGEKDTWSGMRTTGQLRLAHGVRLKANKDSLYKPILRQKKHFNSLHIPKALQKALPFKNKPKTQAKAGKVPKDRRRPAVIREPHERKILALLDALSTVHSQKMKKAKEQRHLHNKEHFRAKQKEEEEKLKRQKDLRKKLFRIQGQKERRNQKSSLKGAEGQLQ

SEQ ID NO: 9243 - protein, 675 aa, Homo sapiens
  Payload ID: 1878;
  Gene Symbol: BMX;
  Gene Name: BMX non-receptor tyr kinase;
  Uniprot ID:  P51813;
  ENSP ID: ENSP00000308774
MDTKSILEELLLKRSQQKKKMSPNNYKERLFVLTKTNLSYYEYDKMKRGSRKGSIEIKKIRCVEKVNLEEQTPVERQYPFQIVYKDGLLYVYASNEESRSQWLKALQKEIRGNPHLLVKYHSGFFVDGKFLCCQQSCKAAPGCTLWEAYANLHTAVNEEKHRVPTFPDRVLKIPRAVPVLKMDAPSSSTTLAQYDNESKKNYGSQPPSSSTSLAQYDSNSKKIYGSQPNFNMQYIPREDFPDWWQVRKLKSSSSSEDVASSNQKERNVNHTTSKISWEFPESSSSEEEENLDDYDWFAGNISRSQSEQLLRQKGKEGAFMVRNSSQVGMYTVSLFSKAVNDKKGTVKHYHVHTNAENKLYLAENYCFDSIPKLIHYHQHNSAGMITRLRHPVSTKANKVPDSVSLGNGIWELKREEITLLKELGSGQFGVVQLGKWKGQYDVAVKMIKEGSMSEDEFFQEAQTMMKLSHPKLVKFYGVCSKEYPIYIVTEYISNGCLLNYLRSHGKGLEPSQLLEMCYDVCEGMAFLESHQFIHRDLAARNCLVDRDLCVKVSDFGMTRYVLDDQYVSSVGTKFPVKWSAPEVFHYFKYSSKSDVWAFGILMWEVFSLGKQPYDLYDNSQVVLKVSQGHRLYRPHLASDTIYQIMYSCWHELPEKRPTFQQLLSSIEPLREKDKH

SEQ ID NO: 9244 - protein, 675 aa, Homo sapiens; identical to SEQ ID NO: 9243
  Payload ID: 1878;
  Gene Symbol: BMX;
  Gene Name: BMX non-receptor tyr kinase;
  Uniprot ID:  P51813;
  ENSP ID: ENSP00000340082

SEQ ID NO: 9245 - protein, 675 aa, Homo sapiens; identical to SEQ ID NO: 9243
  Payload ID: 1878;
  Gene Symbol: BMX;
  Gene Name: BMX non-receptor tyr kinase;
  Uniprot ID:  P51813;
  ENSP ID: ENSP00000350224

SEQ ID NO: 9246 - protein, 354 aa, Homo sapiens
  Payload ID: 1879;
  Gene Symbol: ABO;
  Gene Name: BO blood group (transferase A, alpha 1-3-N-acetylgalactosaminyltransferase;
  transferase B, alpha 1-3-galactosyltransferase);
  ENSP ID: ENSP00000487108
MAEVLRTLAGKPKCHALRPMILFLIMLVLVLFGYGVLSPRSLMPGSLERGFCMAVREPDHLQRVSLPRMVYPQPKVLTPCRKDVLVVTPWLAPIVWEGTFNIDILNEQFRLQNTTIGLTVFAIKKYVAFLKLFLETAEKHFMVGHRVHYYVFTDQLAAVPRVTLGTGRQLSVLEVRAYKRWQDVSMRRMEMISDFCERRFLSEVDYLVCVDVDMEFRDHVGVEILTPLFGTLHPGFYGSSREAFTYERRPQSQAYIPKDEGDFYYLGGFFGGSVQEVQRLTRACHQAMMVDQANGIEAVWHDESHLNKYLLRHKPTKVLSPEYLWDQQLLGWPAVLRKLRFTAVPKNHQAVRNP

SEQ ID NO: 9247 - protein, 941 aa, Homo sapiens
  Payload ID: 1880;
  Gene Symbol: BBX;
  Gene Name: bobby sox homolog (Drosophila);
  Uniprot ID:  Q8WY36;
  ENSP ID: ENSP00000319974
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGPFQSQKKNLFHKIVSKYKHKKEKPNVPEKGSGDKWSNKQLFLDAIHPTEAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 9248 - protein, 891 aa, Homo sapiens
  Payload ID: 1880;
  Gene Symbol: BBX;
  Gene Name: bobby sox homolog (Drosophila);
  ENSP ID: ENSP00000385317
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 9249 - protein, 448 aa, Homo sapiens
  Payload ID: 1880;
  Gene Symbol: BBX;
  Gene Name: bobby sox homolog (Drosophila);
  ENSP ID: ENSP00000385518
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPE

SEQ ID NO: 9250 - protein, 911 aa, Homo sapiens
  Payload ID: 1880;
  Gene Symbol: BBX;
  Gene Name: bobby sox homolog (Drosophila);
  Uniprot ID:  Q8WY36;
  ENSP ID: ENSP00000385530
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEKLKKKKKKSKMDRHGNDKSTPKKTCKKRQSSESDIESVIYTIEAVAKGDWGIEKLGDTPRKKVRTSSSGKGSILDAKPPKKKVKSREKKMSKEKSSDTTKESRPPDFISISASKNISGETPEGIKAEPLTPMEDALPPSLSGQAKPEDSDCHRKIETCGSRKSERSCKGALYKTLVSEGMLTSLRANVDRGKRSSGKGNSSDHEGCWNEESWTFSQSGTSGSKKFKKTKPKEDCLLGSAKLDEEFEKKFNSLPQYSPVTFDRKCVPVPRKKKKTGNVSSEPTKTSKGSGDKWSNKQLFLDAIHPTEAIFSEDRNTMEPVHKVKNIPSIFNTPEPTTTQEPLVGSQKRKARKTKITHLVRTADGRVSPAGGTLDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 9251 - protein, 119 aa, Homo sapiens
  Payload ID: 1880;
  Gene Symbol: BBX;
  Gene Name: bobby sox homolog (Drosophila);
  ENSP ID: ENSP00000392230
MKGSNRNKDHSAEGEGVGKRPKRKCLQWHPLLAKKLLDFSEEEEEEDEEEDIDKTRIEAQYKNRGLACLVLSSCLRNENGAWHIVQLLGADGLEQDVGETEDDESPEQRARRPMNAFLL

SEQ ID NO: 9252 - protein, 13 aa, Homo sapiens
  Payload ID: 1880;
  Gene Symbol: BBX;
  Gene Name: bobby sox homolog (Drosophila);
  ENSP ID: ENSP00000396373
MKGSNRNKDHSAE

SEQ ID NO: 9253 - protein, 71 aa, Homo sapiens
  Payload ID: 1880;
  Gene Symbol: BBX;
  Gene Name: bobby sox homolog (Drosophila);
  ENSP ID: ENSP00000400543
MKGSNRNKDHSAEGEGVGKRPKRKCLQWHPLLAKKLLDFSEEEEEEDEEEDIDKVQLLGADGLEQDVGETE

SEQ ID NO: 9254 - protein, 131 aa, Homo sapiens
  Payload ID: 1880;
  Gene Symbol: BBX;
  Gene Name: bobby sox homolog (Drosophila);
  ENSP ID: ENSP00000401524
NTPEPTTTQEPLVGSQKRKARKTKITHLVRTADGRVSPAGDDKPKEQLQRSLPKATETDCNDKCSHNTEVGETRSSTPEMPAVSAFFSLAALAEVAAMENVHRGQRSTPLTHDGQPKEMPQAPVLISCADQ

SEQ ID NO: 9255 - protein, 80 aa, Homo sapiens
  Payload ID: 1880;
  Gene Symbol: BBX;
  Gene Name: bobby sox homolog (Drosophila);
  ENSP ID: ENSP00000402372
  MOD_RES (1)..(1): Any amino acid
XTKTSKGPFQSQKKNLFHKIVSKYKHKKEKPNVPEKGSGDKWSNKQLFLDAIHPTEEPTTTQEPLVGSQKRKARKTKITH

SEQ ID NO: 9256 - protein, 149 aa, Homo sapiens
  Payload ID: 1880;
  Gene Symbol: BBX;
  Gene Name: bobby sox homolog (Drosophila);
  ENSP ID: ENSP00000403806
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKW

SEQ ID NO: 9257 - protein, 628 aa, Homo sapiens
  Payload ID: 1880;
  Gene Symbol: BBX;
  Gene Name: bobby sox homolog (Drosophila);
  Uniprot ID:  Q8WY36;
  ENSP ID: ENSP00000403860
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEENEAQEKETPLIMKGVGMKKAGHLVRVGPVGARSSRRQSQKKTVSLAPQSWMKNLKKNSTASLNIVLLHLTGNVYLSQEKRRRLEMCPQNRLKPAKVLSSLRKRTYSTKLSANISTKRRSPMFRKKEVGINGQTSNSSWMPFTLQKPYFQKTETPWSLFIRLKISHPFSTLQSQQQRKNLWWAAKREKQGKPRLHTLSGQQMAGYHQQEVLWMTNQRNNCRGVSLKQLRQTAMTNAHTTPRSGRRGAVLQKCLPCLRSLASLRWLKWQPWKMCTEVRGQLRSPMMDSQKKCRRLLYLFPALTSEAPFHCKTLCFTYYPSLVFTEGC

SEQ ID NO: 9258 - protein, 97 aa, Homo sapiens
  Payload ID: 1880;
  Gene Symbol: BBX;
  Gene Name: bobby sox homolog (Drosophila);
  ENSP ID: ENSP00000404654
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSL

SEQ ID NO: 9259 - protein, 85 aa, Homo sapiens
  Payload ID: 1880;
  Gene Symbol: BBX;
  Gene Name: bobby sox homolog (Drosophila);
  ENSP ID: ENSP00000404943
MKGSNRNKDHSAEGEGVGKRPKRKCLQWHPLLAKKLLDFSEEEEEEDEEEDIDKVQLLGADGLEQDVGETEDDESPEQRARRPMN

SEQ ID NO: 9260 - protein, 113 aa, Homo sapiens
  Payload ID: 1880;
  Gene Symbol: BBX;
  Gene Name: bobby sox homolog (Drosophila);
  ENSP ID: ENSP00000406554
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKI

SEQ ID NO: 9261 - protein, 159 aa, Homo sapiens
  Payload ID: 1880;
  Gene Symbol: BBX;
  Gene Name: bobby sox homolog (Drosophila);
  ENSP ID: ENSP00000407662
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKS

SEQ ID NO: 9262 - protein, 144 aa, Homo sapiens
  Payload ID: 1880;
  Gene Symbol: BBX;
  Gene Name: bobby sox homolog (Drosophila);
  ENSP ID: ENSP00000408297
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKAN

SEQ ID NO: 9263 - protein, 911 aa, Homo sapiens; identical to SEQ ID NO: 9250
  Payload ID: 1880;
  Gene Symbol: BBX;
  Gene Name: bobby sox homolog (Drosophila);
  Uniprot ID:  Q8WY36;
  ENSP ID: ENSP00000408358

SEQ ID NO: 9264 - protein, 24 aa, Homo sapiens
  Payload ID: 1880;
  Gene Symbol: BBX;
  Gene Name: bobby sox homolog (Drosophila);
  ENSP ID: ENSP00000412390
MKGSNRNKDHSAEGEGVGKRPKRK

SEQ ID NO: 9265 - protein, 205 aa, Homo sapiens
  Payload ID: 1880;
  Gene Symbol: BBX;
  Gene Name: bobby sox homolog (Drosophila);
  ENSP ID: ENSP00000413274
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQM

SEQ ID NO: 9266 - protein, 193 aa, Homo sapiens
  Payload ID: 1880;
  Gene Symbol: BBX;
  Gene Name: bobby sox homolog (Drosophila);
  ENSP ID: ENSP00000413320
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMP

SEQ ID NO: 9267 - protein, 166 aa, Homo sapiens
  Payload ID: 1880;
  Gene Symbol: BBX;
  Gene Name: bobby sox homolog (Drosophila);
  ENSP ID: ENSP00000414673
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNP

SEQ ID NO: 9268 - protein, 1115 aa, Homo sapiens
  Payload ID: 1881;
  Gene Symbol: BOC;
  Gene Name: BOC cell adhesion associated, oncogene regulated;
  Uniprot ID:  Q9BWV1;
  ENSP ID: ENSP00000273395
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKQVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 9269 - protein, 1114 aa, Homo sapiens
  Payload ID: 1881;
  Gene Symbol: BOC;
  Gene Name: BOC cell adhesion associated, oncogene regulated;
  Uniprot ID:  Q9BWV1;
  ENSP ID: ENSP00000347546
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 9270 - protein, 157 aa, Homo sapiens
  Payload ID: 1881;
  Gene Symbol: BOC;
  Gene Name: BOC cell adhesion associated, oncogene regulated;
  ENSP ID: ENSP00000417337
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLASESAPLPPCHGAVPPHLSHPEAPTIHAASCYS

SEQ ID NO: 9271 - protein, 84 aa, Homo sapiens
  Payload ID: 1881;
  Gene Symbol: BOC;
  Gene Name: BOC cell adhesion associated, oncogene regulated;
  ENSP ID: ENSP00000417362
MLRGTMTAWRGMRPEVTLACLLLATAGCFADLNEVPQVTVQPASTVQKPGGTVILGCVVEPPRMNVTWRLNGKELNGSDDALGV

SEQ ID NO: 9272 - protein, 21 aa, Homo sapiens
  Payload ID: 1881;
  Gene Symbol: BOC;
  Gene Name: BOC cell adhesion associated, oncogene regulated;
  ENSP ID: ENSP00000418118
MLRGTMTAWRGMRPEVTLACL

SEQ ID NO: 9273 - protein, 39 aa, Homo sapiens
  Payload ID: 1881;
  Gene Symbol: BOC;
  Gene Name: BOC cell adhesion associated, oncogene regulated;
  ENSP ID: ENSP00000418182
  MOD_RES (1)..(1): Any amino acid
XQQQSDTSSLLRQTHLGNGYDPQSHQITRAPMLLGPCAS

SEQ ID NO: 9274 - protein, 32 aa, Homo sapiens
  Payload ID: 1881;
  Gene Symbol: BOC;
  Gene Name: BOC cell adhesion associated, oncogene regulated;
  ENSP ID: ENSP00000418260
MLRGTMTAWRGMRPEVTLACLLLATAGCFADL

SEQ ID NO: 9275 - protein, 1114 aa, Homo sapiens; identical to SEQ ID NO: 9269
  Payload ID: 1881;
  Gene Symbol: BOC;
  Gene Name: BOC cell adhesion associated, oncogene regulated;
  Uniprot ID:  Q9BWV1;
  ENSP ID: ENSP00000418663

SEQ ID NO: 9276 - protein, 65 aa, Homo sapiens
  Payload ID: 1881;
  Gene Symbol: BOC;
  Gene Name: BOC cell adhesion associated, oncogene regulated;
  ENSP ID: ENSP00000419022
MTHEVLSTFIPSEGSSSKVEEVDLQDFKLDVQHVIEVDEGNTAVIACHLPESHPKAQVRYSVKQE

SEQ ID NO: 9277 - protein, 84 aa, Homo sapiens
  Payload ID: 1881;
  Gene Symbol: BOC;
  Gene Name: BOC cell adhesion associated, oncogene regulated;
  ENSP ID: ENSP00000420056
  MOD_RES (1)..(1): Any amino acid
XRACANGIHMNRGCPSAAVGYPGMKPQQHCPGELQQQSDTSSLLRQTHLGNGYDPQSHQITSCCSPITTAANARSSLLLWASQG

SEQ ID NO: 9278 - protein, 157 aa, Homo sapiens; identical to SEQ ID NO: 9270
  Payload ID: 1881;
  Gene Symbol: BOC;
  Gene Name: BOC cell adhesion associated, oncogene regulated;
  ENSP ID: ENSP00000420154

SEQ ID NO: 9279 - protein, 137 aa, Homo sapiens
  Payload ID: 1882;
  Gene Symbol: BOLA1;
  Gene Name: bolA family member 1;
  Uniprot ID:  Q9Y3E2;
  ENSP ID: ENSP00000358146
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSPPCLGGNKKTLGTP

SEQ ID NO: 9280 - protein, 137 aa, Homo sapiens; identical to SEQ ID NO: 9279
  Payload ID: 1882;
  Gene Symbol: BOLA1;
  Gene Name: bolA family member 1;
  Uniprot ID:  Q9Y3E2;
  ENSP ID: ENSP00000358148

SEQ ID NO: 9281 - protein, 137 aa, Homo sapiens; identical to SEQ ID NO: 9279
  Payload ID: 1882;
  Gene Symbol: BOLA1;
  Gene Name: bolA family member 1;
  Uniprot ID:  Q9Y3E2;
  ENSP ID: ENSP00000358149

SEQ ID NO: 9282 - protein, 152 aa, Homo sapiens
  Payload ID: 1883;
  Gene Symbol: BOLA2;
  Gene Name: bolA family member 2;
  Uniprot ID:  Q9H3K6;
  ENSP ID: ENSP00000331127
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRLVNACLAEELPHIHAFEQKTLTPDQWARERQK

SEQ ID NO: 9283 - protein, 152 aa, Homo sapiens; identical to SEQ ID NO: 9282
  Payload ID: 1883;
  Gene Symbol: BOLA2;
  Gene Name: bolA family member 2;
  ENSP ID: ENSP00000482868

SEQ ID NO: 9284 - protein, 152 aa, Homo sapiens; identical to SEQ ID NO: 9282
  Payload ID: 1884;
  Gene Symbol: BOLA2B;
  Gene Name: bolA family member 2B;
  Uniprot ID:  Q9H3K6;
  ENSP ID: ENSP00000306752

SEQ ID NO: 9285 - protein, 81 aa, Homo sapiens
  Payload ID: 1884;
  Gene Symbol: BOLA2B;
  Gene Name: bolA family member 2B;
  ENSP ID: ENSP00000455468
  MOD_RES (1)..(1): Any amino acid
XGSVAGARAGVVSLLGCRSSWTAAMELSAEYLREKLQRDLEAEHVLPSPGGVGQVRGETAASETQAGERVPSRRAPAHPCL

SEQ ID NO: 9286 - protein, 88 aa, Homo sapiens
  Payload ID: 1884;
  Gene Symbol: BOLA2B;
  Gene Name: bolA family member 2B;
  ENSP ID: ENSP00000457995
FPAEVAPVRQQGSVAGARAGVVSLLGCRSSWTAAMELSAEYLREKLQRDLEAEHVEVEDTTLNRCSCSFRVLVVSAKFEGKPLLQRHR

SEQ ID NO: 9287 - protein, 101 aa, Homo sapiens
  Payload ID: 1885;
  Gene Symbol: BOLA3;
  Gene Name: bolA family member 3;
  Uniprot ID:  Q53S33;
  ENSP ID: ENSP00000295326
MAAWSPAAAAPLLRGIRGLPLHHRMFATQTEGELRVTQILKEKFPRATAIKVTDISGTKRRNQRDAWIADIYLCPQTLTTPWLHRCCCLRPWMNFTDIILP

SEQ ID NO: 9288 - protein, 107 aa, Homo sapiens
  Payload ID: 1885;
  Gene Symbol: BOLA3;
  Gene Name: bolA family member 3;
  Uniprot ID:  Q53S33;
  ENSP ID: ENSP00000331369
MAAWSPAAAAPLLRGIRGLPLHHRMFATQTEGELRVTQILKEKFPRATAIKVTDISGGCGAMYEIKIESEEFKEKRTVQQHQMVNQALKEEIKEMHGLRIFTSVPKR

SEQ ID NO: 9289 - protein, 399 aa, Homo sapiens
  Payload ID: 1886;
  Gene Symbol: BRS3;
  Gene Name: bombesin-like receptor 3;
  Uniprot ID:  P32247;
  ENSP ID: ENSP00000359682
MAQRQPHSPNQTLISITNDTESSSSVVSNDNTNKGWSGDNSPGIEALCAIYITYAVIISVGILGNAILIKVFFKTKSMQTVPNIFITSLAFGDLLLLLTCVPVDATHYLAEGWLFGRIGCKVLSFIRLTSVGVSVFTLTILSADRYKAVVKPLERQPSNAILKTCVKAGCVWIVSMIFALPEAIFSNVYTFRDPNKNMTFESCTSYPVSKKLLQEIHSLLCFLVFYIIPLSIISVYYSLIARTLYKSTLNIPTEEQSHARKQIESRKRIARTVLVLVALFALCWLPNHLLYLYHSFTSQTYVDPSAMHFIFTIFSRVLAFSNSCVNPFALYWLSKSFQKHFKAQLFCCKAERPEPPVADTSLTTLAVMGTVPGTGSIQMSEISVTSFTGCSVKQAEDRF

SEQ ID NO: 9290 - protein, 100 aa, Homo sapiens
  Payload ID: 1887;
  Gene Symbol: BGLAP;
  Gene Name: bone gamma-carboxyglutamate (gla) prt;
  Uniprot ID:  P02818;
  ENSP ID: ENSP00000357255
MRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 9291 - protein, 318 aa, Homo sapiens
  Payload ID: 1888;
  Gene Symbol: BST1;
  Gene Name: bone marrow stromal cell antigen 1;
  Uniprot ID:  Q10588;
  ENSP ID: ENSP00000265016
MAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSAAAATQRKAPSLYTEQRAGLIIPLFLVLASRTQL

SEQ ID NO: 9292 - protein, 333 aa, Homo sapiens
  Payload ID: 1888;
  Gene Symbol: BST1;
  Gene Name: bone marrow stromal cell antigen 1;
  ENSP ID: ENSP00000371783
MAAQGCAASRLLQLLLQLLLLLLLLAAGGARARWRGEGTSAHLRDIFLGRCAEYRALLSPEQRQIRNSREPPVLHTTQNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSAAAATQRKAPSLYTEQRAGLIIPLFLVLASRTQL

SEQ ID NO: 9293 - protein, 155 aa, Homo sapiens
  Payload ID: 1888;
  Gene Symbol: BST1;
  Gene Name: bone marrow stromal cell antigen 1;
  ENSP ID: ENSP00000420925
GLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSPKRLCGTLGVRPRAEPYNRRF

SEQ ID NO: 9294 - protein, 186 aa, Homo sapiens
  Payload ID: 1888;
  Gene Symbol: BST1;
  Gene Name: bone marrow stromal cell antigen 1;
  ENSP ID: ENSP00000423357
  MOD_RES (1)..(1): Any amino acid
XSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSDGVSPC

SEQ ID NO: 9295 - protein, 97 aa, Homo sapiens
  Payload ID: 1888;
  Gene Symbol: BST1;
  Gene Name: bone marrow stromal cell antigen 1;
  ENSP ID: ENSP00000424761
  MOD_RES (1)..(1): Any amino acid
XSEPTGAYPIKGFFADYEIPNLQKEKITRIEIWVMHEIGGPNVESCGEGSMKVLEKRLKDMGFQYSCINDYRPVKLLQCVDHSTHPDCALKSKLWEP

SEQ ID NO: 9296 - protein, 180 aa, Homo sapiens
  Payload ID: 1889;
  Gene Symbol: BST2;
  Gene Name: bone marrow stromal cell antigen 2;
  Uniprot ID:  Q10589;
  ENSP ID: ENSP00000252593
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 9297 - protein, 986 aa, Homo sapiens
  Payload ID: 1890;
  Gene Symbol: BMP1;
  Gene Name: bone morphogenetic prt 1;
  Uniprot ID:  P13497;
  ENSP ID: ENSP00000305714
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 9298 - protein, 730 aa, Homo sapiens
  Payload ID: 1890;
  Gene Symbol: BMP1;
  Gene Name: bone morphogenetic prt 1;
  Uniprot ID:  P13497;
  ENSP ID: ENSP00000306121
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 9299 - protein, 302 aa, Homo sapiens
  Payload ID: 1890;
  Gene Symbol: BMP1;
  Gene Name: bone morphogenetic prt 1;
  ENSP ID: ENSP00000346941
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGVLHSSLLLLSCGSRNGASFPCSLESSIHQALCWTGLFLRPSPFPRLPLAAPRTLRAGV

SEQ ID NO: 9300 - protein, 189 aa, Homo sapiens
  Payload ID: 1890;
  Gene Symbol: BMP1;
  Gene Name: bone morphogenetic prt 1;
  ENSP ID: ENSP00000380915
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGSGPPP

SEQ ID NO: 9301 - protein, 189 aa, Homo sapiens; identical to SEQ ID NO: 9300
  Payload ID: 1890;
  Gene Symbol: BMP1;
  Gene Name: bone morphogenetic prt 1;
  ENSP ID: ENSP00000427950

SEQ ID NO: 9302 - protein, 302 aa, Homo sapiens; identical to SEQ ID NO: 9299
  Payload ID: 1890;
  Gene Symbol: BMP1;
  Gene Name: bone morphogenetic prt 1;
  ENSP ID: ENSP00000428249

SEQ ID NO: 9303 - protein, 730 aa, Homo sapiens; identical to SEQ ID NO: 9298
  Payload ID: 1890;
  Gene Symbol: BMP1;
  Gene Name: bone morphogenetic prt 1;
  Uniprot ID:  P13497;
  ENSP ID: ENSP00000428332

SEQ ID NO: 9304 - protein, 622 aa, Homo sapiens
  Payload ID: 1890;
  Gene Symbol: BMP1;
  Gene Name: bone morphogenetic prt 1;
  Uniprot ID:  P13497;
  ENSP ID: ENSP00000428665
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEGCYDLQVGKPLLWDRHCFRLSTHGPEMLGTALRG

SEQ ID NO: 9305 - protein, 189 aa, Homo sapiens; identical to SEQ ID NO: 9300
  Payload ID: 1890;
  Gene Symbol: BMP1;
  Gene Name: bone morphogenetic prt 1;
  ENSP ID: ENSP00000428798

SEQ ID NO: 9306 - protein, 61 aa, Homo sapiens
  Payload ID: 1890;
  Gene Symbol: BMP1;
  Gene Name: bone morphogenetic prt 1;
  ENSP ID: ENSP00000430015
MPGVARLPLLLGLLLLPRPGRPLDLADYTYDLAEEDDSEPLNYKDPCKLPFLGTLPWTKRT

SEQ ID NO: 9307 - protein, 717 aa, Homo sapiens
  Payload ID: 1890;
  Gene Symbol: BMP1;
  Gene Name: bone morphogenetic prt 1;
  Uniprot ID:  P13497;
  ENSP ID: ENSP00000430406
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSGGELFGLLGHPPRRP

SEQ ID NO: 9308 - protein, 189 aa, Homo sapiens; identical to SEQ ID NO: 9300
  Payload ID: 1890;
  Gene Symbol: BMP1;
  Gene Name: bone morphogenetic prt 1;
  ENSP ID: ENSP00000430977

SEQ ID NO: 9309 - protein, 424 aa, Homo sapiens
  Payload ID: 1891;
  Gene Symbol: BMP10;
  Gene Name: bone morphogenetic prt 10;
  Uniprot ID:  O95393;
  ENSP ID: ENSP00000295379
MGSLVLTLCALFCLAAYLVSGSPIMNLEQSPLEEDMSLFGDVFSEQDGVDFNTLLQSMKDEFLKTLNLSDIPTQDSAKVDPPEYMLELYNKFATDRTSMPSANIIRSFKNEDLFSQPVSFNGLRKYPLLFNVSIPHHEEVIMAELRLYTLVQRDRMIYDGVDRKITIFEVLESKGDNEGERNMLVLVSGEIYGTNSEWETFDVTDAIRRWQKSGSSTHQLEVHIESKHDEAEDASSGRLEIDTSAQNKHNPLLIVFSDDQSSDKERKEELNEMISHEQLPELDNLGLDSFSSGPGEEALLQMRSNIIYDSTARIRRNAKGNYCKRTPLYIDFKEIGWDSWIIAPPGYEAYECRGVCNYPLAEHLTPTKHAIIQALVHLKNSQKASKACCVPTKLEPISILYLDKGVVTYKFKYEGMAVSECGCR

SEQ ID NO: 9310 - protein, 392 aa, Homo sapiens
  Payload ID: 1892;
  Gene Symbol: BMP15;
  Gene Name: bone morphogenetic prt 15;
  Uniprot ID:  O95972;
  ENSP ID: ENSP00000252677
MVLLSILRILFLCELVLFMEHRAQMAEGGQSSIALLAEAPTLPLIEELLEESPGEQPRKPRLLGHSLRYMLELYRRSADSHGHPRENRTIGATMVRLVKPLTNVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 9311 - protein, 396 aa, Homo sapiens
  Payload ID: 1893;
  Gene Symbol: BMP2;
  Gene Name: bone morphogenetic prt 2;
  Uniprot ID:  P12643;
  ENSP ID: ENSP00000368104
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 9312 - protein, 472 aa, Homo sapiens
  Payload ID: 1894;
  Gene Symbol: BMP3;
  Gene Name: bone morphogenetic prt 3;
  Uniprot ID:  P12645;
  ENSP ID: ENSP00000282701
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 9313 - protein, 408 aa, Homo sapiens
  Payload ID: 1895;
  Gene Symbol: BMP4;
  Gene Name: bone morphogenetic prt 4;
  Uniprot ID:  P12644;
  ENSP ID: ENSP00000245451
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 9314 - protein, 408 aa, Homo sapiens; identical to SEQ ID NO: 9313
  Payload ID: 1895;
  Gene Symbol: BMP4;
  Gene Name: bone morphogenetic prt 4;
  Uniprot ID:  P12644;
  ENSP ID: ENSP00000394165

SEQ ID NO: 9315 - protein, 271 aa, Homo sapiens
  Payload ID: 1895;
  Gene Symbol: BMP4;
  Gene Name: bone morphogenetic prt 4;
  ENSP ID: ENSP00000453365
MFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQA

SEQ ID NO: 9316 - protein, 110 aa, Homo sapiens
  Payload ID: 1895;
  Gene Symbol: BMP4;
  Gene Name: bone morphogenetic prt 4;
  ENSP ID: ENSP00000453467
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERP

SEQ ID NO: 9317 - protein, 408 aa, Homo sapiens; identical to SEQ ID NO: 9313
  Payload ID: 1895;
  Gene Symbol: BMP4;
  Gene Name: bone morphogenetic prt 4;
  Uniprot ID:  P12644;
  ENSP ID: ENSP00000453485

SEQ ID NO: 9318 - protein, 104 aa, Homo sapiens
  Payload ID: 1895;
  Gene Symbol: BMP4;
  Gene Name: bone morphogenetic prt 4;
  ENSP ID: ENSP00000453691
LIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEASLRTR

SEQ ID NO: 9319 - protein, 408 aa, Homo sapiens; identical to SEQ ID NO: 9313
  Payload ID: 1895;
  Gene Symbol: BMP4;
  Gene Name: bone morphogenetic prt 4;
  Uniprot ID:  P12644;
  ENSP ID: ENSP00000454134

SEQ ID NO: 9320 - protein, 29 aa, Homo sapiens
  Payload ID: 1895;
  Gene Symbol: BMP4;
  Gene Name: bone morphogenetic prt 4;
  ENSP ID: ENSP00000476690
NTVRSFHHEGQSLPPVCVGEGWWDWLEGQ

SEQ ID NO: 9321 - protein, 454 aa, Homo sapiens
  Payload ID: 1896;
  Gene Symbol: BMP5;
  Gene Name: bone morphogenetic prt 5;
  Uniprot ID:  P22003;
  ENSP ID: ENSP00000359866
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQDWIIAPEGYAAFYCDGECSFPLNAHMNATNHAIVQTLVHLMFPDHVPKPCCAPTKLNAISVLYFDDSSNVILKKYRNMVVRSCGCH

SEQ ID NO: 9322 - protein, 513 aa, Homo sapiens
  Payload ID: 1897;
  Gene Symbol: BMP6;
  Gene Name: bone morphogenetic prt 6;
  Uniprot ID:  P22004;
  ENSP ID: ENSP00000283147
MPGLGRRAQWLCWWWGLLCSCCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 9323 - protein, 431 aa, Homo sapiens
  Payload ID: 1898;
  Gene Symbol: BMP7;
  Gene Name: bone morphogenetic prt 7;
  Uniprot ID:  P18075;
  ENSP ID: ENSP00000379204
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 9324 - protein, 365 aa, Homo sapiens
  Payload ID: 1898;
  Gene Symbol: BMP7;
  Gene Name: bone morphogenetic prt 7;
  ENSP ID: ENSP00000379205
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 9325 - protein, 297 aa, Homo sapiens
  Payload ID: 1898;
  Gene Symbol: BMP7;
  Gene Name: bone morphogenetic prt 7;
  ENSP ID: ENSP00000390814
  MOD_RES (1)..(1): Any amino acid
XPPLASLQDSHFLTDADMVMSFVNLVEHDKEFFHPRYHHREFRFDLSKIPEGEAVTAAEFRIYKDYIRERFDNETFRISVYQVLQEHLGSTGTCCMPCLRASTRTNQTRVPALWKLTFQQRRGHGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATN

SEQ ID NO: 9326 - protein, 412 aa, Homo sapiens
  Payload ID: 1898;
  Gene Symbol: BMP7;
  Gene Name: bone morphogenetic prt 7;
  ENSP ID: ENSP00000398687
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVGVTPSWGVVTWAGQAAGPPDPAASKLGPE

SEQ ID NO: 9327 - protein, 402 aa, Homo sapiens
  Payload ID: 1899;
  Gene Symbol: BMP8A;
  Gene Name: bone morphogenetic prt 8a;
  Uniprot ID:  Q7Z5Y6;
  ENSP ID: ENSP00000327440
MAARPGPLWLLGLTLCALGGGGPGLRPPPGCPQRRLGARERRDVQREILAVLGLPGRPRPRAPPAASRLPASAPLFMLDLYHAMAGDDDEDGAPAEQRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVRGSHGRQVCRRHELYVSFQDLGWLDWVIAPQGYSAYYCEGECSFPLDSCMNATNHAILQSLVHLMKPNAVPKACCAPTKLSATSVLYYDSSNNVILRKHRNMVVKACGCH

SEQ ID NO: 9328 - protein, 402 aa, Homo sapiens
  Payload ID: 1900;
  Gene Symbol: BMP8B;
  Gene Name: bone morphogenetic prt 8b;
  Uniprot ID:  P34820;
  ENSP ID: ENSP00000361915
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLVHLMMPDAVPKACCAPTKLSATSVLYYDSSNNVILRKHRNMVVKACGCH

SEQ ID NO: 9329 - protein, 349 aa, Homo sapiens
  Payload ID: 1900;
  Gene Symbol: BMP8B;
  Gene Name: bone morphogenetic prt 8b;
  Uniprot ID:  P34820;
  ENSP ID: ENSP00000380518
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGETWTGWGWTKDSRLQMWKLRLSRTPWVLSLHAPGPAQAPAERPLLCLLQGHCPASPSPIRTPRAVRPLRRRQPKKSNELPQANRLPGIFDDVHGSHGRQVCRRHELYVSFQDLGWLVIADSSCF

SEQ ID NO: 9330 - protein, 532 aa, Homo sapiens
  Payload ID: 1901;
  Gene Symbol: BMPR1A;
  Gene Name: bone morphogenetic prt receptor, type IA;
  Uniprot ID:  P36894;
  ENSP ID: ENSP00000361107
MPQLYIYIRLLGAYLFIISRVQGQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 9331 - protein, 41 aa, Homo sapiens
  Payload ID: 1901;
  Gene Symbol: BMPR1A;
  Gene Name: bone morphogenetic prt receptor, type IA;
  ENSP ID: ENSP00000483569
MPQLYIYIRLLGAYLFIISRVQGQNLDSMLHGTGMKSDSDQ

SEQ ID NO: 9332 - protein, 502 aa, Homo sapiens
  Payload ID: 1902;
  Gene Symbol: BMPR1B;
  Gene Name: bone morphogenetic prt receptor, type IB;
  Uniprot ID:  O00238;
  ENSP ID: ENSP00000264568
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 9333 - protein, 502 aa, Homo sapiens; identical to SEQ ID NO: 9332
  Payload ID: 1902;
  Gene Symbol: BMPR1B;
  Gene Name: bone morphogenetic prt receptor, type IB;
  Uniprot ID:  O00238;
  ENSP ID: ENSP00000378389

SEQ ID NO: 9334 - protein, 532 aa, Homo sapiens
  Payload ID: 1902;
  Gene Symbol: BMPR1B;
  Gene Name: bone morphogenetic prt receptor, type IB;
  Uniprot ID:  O00238;
  ENSP ID: ENSP00000401907
MGWLEELNWQLHIFLLILLSMHTRANFLDNMLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 9335 - protein, 125 aa, Homo sapiens
  Payload ID: 1902;
  Gene Symbol: BMPR1B;
  Gene Name: bone morphogenetic prt receptor, type IB;
  ENSP ID: ENSP00000421144
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHH

SEQ ID NO: 9336 - protein, 502 aa, Homo sapiens; identical to SEQ ID NO: 9332
  Payload ID: 1902;
  Gene Symbol: BMPR1B;
  Gene Name: bone morphogenetic prt receptor, type IB;
  Uniprot ID:  O00238;
  ENSP ID: ENSP00000421671

SEQ ID NO: 9337 - protein, 114 aa, Homo sapiens
  Payload ID: 1902;
  Gene Symbol: BMPR1B;
  Gene Name: bone morphogenetic prt receptor, type IB;
  ENSP ID: ENSP00000424693
MLLRSAGKLNVGTKKEDGESTAPTPRPKVLRCKCHHHCPEDSVNNICSTDGYCFTMIEEDDSGLPVVTSGCLGLEGSDFQCRVRTLPFLIKEDQLNAAQKGTNVIKTYTLHCLH

SEQ ID NO: 9338 - protein, 502 aa, Homo sapiens; identical to SEQ ID NO: 9332
  Payload ID: 1902;
  Gene Symbol: BMPR1B;
  Gene Name: bone morphogenetic prt receptor, type IB;
  Uniprot ID:  O00238;
  ENSP ID: ENSP00000425444

SEQ ID NO: 9339 - protein, 502 aa, Homo sapiens; identical to SEQ ID NO: 9332
  Payload ID: 1902;
  Gene Symbol: BMPR1B;
  Gene Name: bone morphogenetic prt receptor, type IB;
  Uniprot ID:  O00238;
  ENSP ID: ENSP00000426617

SEQ ID NO: 9340 - protein, 530 aa, Homo sapiens
  Payload ID: 1903;
  Gene Symbol: BMPR2;
  Gene Name: bone morphogenetic prt receptor, type II (serine/threonine kinase);
  Uniprot ID:  Q13873;
  ENSP ID: ENSP00000363702
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERR

SEQ ID NO: 9341 - protein, 1038 aa, Homo sapiens
  Payload ID: 1903;
  Gene Symbol: BMPR2;
  Gene Name: bone morphogenetic prt receptor, type II (serine/threonine kinase);
  Uniprot ID:  Q13873;
  ENSP ID: ENSP00000363708
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 9342 - protein, 761 aa, Homo sapiens
  Payload ID: 1904;
  Gene Symbol: BRINP1;
  Gene Name: bone morphogenetic prt/retinoic acid inducible neural-specific 1;
  Uniprot ID:  O60477;
  ENSP ID: ENSP00000265922
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 9343 - protein, 320 aa, Homo sapiens
  Payload ID: 1904;
  Gene Symbol: BRINP1;
  Gene Name: bone morphogenetic prt/retinoic acid inducible neural-specific 1;
  Uniprot ID:  O60477;
  ENSP ID: ENSP00000363075
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSGRESHSVPLHEWP

SEQ ID NO: 9344 - protein, 783 aa, Homo sapiens
  Payload ID: 1905;
  Gene Symbol: BRINP2;
  Gene Name: bone morphogenetic prt/retinoic acid inducible neural-specific 2;
  Uniprot ID:  Q9C0B6;
  ENSP ID: ENSP00000354481
MRWQCGTRFRGLRPAVAPWTALLALGLPGWVLAVSATAAAVVPEQHASVAGQHPLDWLLTDRGPFHRAQEYADFMERYRQGFTTRYRIYREFARWKVNNLALERKDFFSLPLPLAPEFIRNIRLLGRRPNLQQVTENLIKKYGTHFLLSATLGGEESLTIFVDKQKLGRKTETTGGASIIGGSGNSTAVSLETLHQLAASYFIDRESTLRRLHHIQIATGAIKVTETRTGPLGCSNYDNLDSVSSVLVQSPENKVQLLGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKERSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 9345 - protein, 766 aa, Homo sapiens
  Payload ID: 1906;
  Gene Symbol: BRINP3;
  Gene Name: bone morphogenetic prt/retinoic acid inducible neural-specific 3;
  Uniprot ID:  Q76B58;
  ENSP ID: ENSP00000356432
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESDEFKLFMKRLPMNYFLNTSTIMHLWTMDSNFQRRYEQLENSMKQLFLKAQKIVHKLFSLSKRCHKQPLISLPRQRTSTYWLTRIQSFLYCNENGLLGSFSEETHSCTCPNDQVVCTAFLPCTVGDASACLTCAPDNRTRCGTCNTGYMLSQGLCKPEVAESTDHYIGFETDLQDLEMKYLLQKTDRRIEVHAIFISNDMRLNSWFDPSWRKRMLLTLKSNKYKSSLVHMILGLSLQICLTKNSTLEPVLAVYVNPFGGSHSESWFMPVNENSFPDWERTKLDLPLQCYNWTLTLGNKWKTFFETVHIYLRSRIKSNGPNGNESIYYEPLEFIDPSRNLGYMKINNIQVFGYSMHFDPEAIRDLILQLDYPYTQGSQDSALLQLLEIRDRVNKLSPPGQRRLDLFSCLLRHRLKLSTSEVVRIQSALQAFNAKLPNTMDYDTTKLCS

SEQ ID NO: 9346 - protein, 28 aa, Homo sapiens
  Payload ID: 1906;
  Gene Symbol: BRINP3;
  Gene Name: bone morphogenetic prt/retinoic acid inducible neural-specific 3;
  ENSP ID: ENSP00000393441
MIWRSRAGAELFSLMALWEWIALSLHCW

SEQ ID NO: 9347 - protein, 158 aa, Homo sapiens
  Payload ID: 1906;
  Gene Symbol: BRINP3;
  Gene Name: bone morphogenetic prt/retinoic acid inducible neural-specific 3;
  ENSP ID: ENSP00000487601
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSK

SEQ ID NO: 9348 - protein, 214 aa, Homo sapiens
  Payload ID: 1907;
  Gene Symbol: BORA;
  Gene Name: bora, aurora kinase A activator;
  ENSP ID: ENSP00000367045
  MOD_RES (1)..(1): Any amino acid
XKSLCLSWKLAWPPELPGVGTGGFVLYAPTPGKFRWSIDQLAVINPVEIDPEDIHRQALYLSHSRIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVK

SEQ ID NO: 9349 - protein, 489 aa, Homo sapiens
  Payload ID: 1907;
  Gene Symbol: BORA;
  Gene Name: bora, aurora kinase A activator;
  Uniprot ID:  Q6PGQ7;
  ENSP ID: ENSP00000367046
MNKLSPVLLFLNQQNYQIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 9350 - protein, 619 aa, Homo sapiens
  Payload ID: 1907;
  Gene Symbol: BORA;
  Gene Name: bora, aurora kinase A activator;
  ENSP ID: ENSP00000375082
MAGRHDWLVAHKPRALVGPRQRGSGELKSLCLSWKLAWPPELPGVGTGGFVLYAPFSLCAMGDVKESKMQITPETPGRIPVLNPFESPSDYSNLHEQTLASPSVFKSTKLPTPGKFRWSIDQLAVINPVEIDPEDIHRQALYLSHSRIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 9351 - protein, 634 aa, Homo sapiens
  Payload ID: 1907;
  Gene Symbol: BORA;
  Gene Name: bora, aurora kinase A activator;
  ENSP ID: ENSP00000479266
MERFLFPAPDLPARSPLVNGSSQGVGVEERGTRKSGHVGLGATPPSHSIQGSRLHLNLPEVDSFPPHPAKFSLCAMGDVKESKMQITPETPGRIPVLNPFESPSDYSNLHEQTLASPSVFKSTKLPTPGKFRWSIDQLAVINPVEIDPEDIHRQALYLSHSRIDKDVEDKRQKAIEEFFTKDVIVPSPWTDHEGKQLSQCHSSKCTNINSDSPVGKKLTIHSEKSDAACQTLLSLPVDFNLENILGDYFRADEFADQSPGNLSSSSLRRKLFLDGNGSISDSLPSASPGSPHSGVQTSLEMFYSIDLSPVKCRSPLQTPSSGQFSSSPIQASAKKYSLGSITSPSPISSPTFSPIEFQIGETPLSEQRKFTVHSPDASSGTNSNGITNPCIRSPYIDGCSPIKNWSPMRLQMYSGGTQYRTSVIQIPFTLETQGEDEEDKENIPSTDVSSPAMDAAGIHLRQFSNEASTHGTHLVVTAMSVTQNQSSASEKELALLQDVEREKDNNTVDMVDPIEIADETTWIKEPVDNGSLPMTDFVSGIAFSIENSHMCMSPLAESSVIPCESSNIQMDSGYNTQNCGSNIMDTVGAESYCKESDAQTCEVESKSQAFNMKQDHTTQRCWMKTASPFQCSSP

SEQ ID NO: 9352 - protein, 114 aa, Homo sapiens
  Payload ID: 1907;
  Gene Symbol: BORA;
  Gene Name: bora, aurora kinase A activator;
  ENSP ID: ENSP00000479349
MAGRHDWLVAHKPRALVGPRQRGSGELKSLCLSWKLAWPPELPGVGTGGFVLYAPFSLCAMGDVKESKMQITPETPGRIPVLNPFESPSDYSNLHEQTLASPSVFKSTKLPALT

SEQ ID NO: 9353 - protein, 106 aa, Homo sapiens; identical to SEQ ID NO: 9212
  Payload ID: 1908;
  Gene Symbol: BORCS7-ASMT;
  Gene Name: BORCS7-ASMT readthrough (NMD candidate);
  ENSP ID: ENSP00000299353

SEQ ID NO: 9354 - protein, 365 aa, Homo sapiens
  Payload ID: 1909;
  Gene Symbol: BORCS8-MEF2B;
  Gene Name: BORCS8-MEF2B readthrough;
  ENSP ID: ENSP00000390762
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPVGAEAWARRVPQPAAPPRRPPQSASSLSASLRPPGAPATFLRPSPIPCSSPGPWQSLCGLGPPCAGCPWPTAGPGRRSPGGTSPERSPGTARARGDPTSLQASSEKTQQ

SEQ ID NO: 9355 - protein, 382 aa, Homo sapiens
  Payload ID: 1909;
  Gene Symbol: BORCS8-MEF2B;
  Gene Name: BORCS8-MEF2B readthrough;
  ENSP ID: ENSP00000454967
MPVPRATDKDHSTQPGTMGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPVGAEAWARRVPQPAAPPRRPPQSASSLSASLRPPGAPATFLRPSPIPCSSPGPWQSLCGLGPPCAGCPWPTAGPGRRSPGGTSPERSPGTARARGDPTSLQASSEKTQQ

SEQ ID NO: 9356 - protein, 119 aa, Homo sapiens; identical to SEQ ID NO: 9215
  Payload ID: 1909;
  Gene Symbol: BORCS8-MEF2B;
  Gene Name: BORCS8-MEF2B readthrough;
  ENSP ID: ENSP00000457957

SEQ ID NO: 9357 - protein, 119 aa, Homo sapiens; identical to SEQ ID NO: 9215
  Payload ID: 1909;
  Gene Symbol: BORCS8-MEF2B;
  Gene Name: BORCS8-MEF2B readthrough;
  ENSP ID: ENSP00000473369

SEQ ID NO: 9358 - protein, 119 aa, Homo sapiens; identical to SEQ ID NO: 9215
  Payload ID: 1909;
  Gene Symbol: BORCS8-MEF2B;
  Gene Name: BORCS8-MEF2B readthrough;
  ENSP ID: ENSP00000473577

SEQ ID NO: 9359 - protein, 119 aa, Homo sapiens; identical to SEQ ID NO: 9215
  Payload ID: 1909;
  Gene Symbol: BORCS8-MEF2B;
  Gene Name: BORCS8-MEF2B readthrough;
  ENSP ID: ENSP00000486975

SEQ ID NO: 9360 - protein, 174 aa, Homo sapiens
  Payload ID: 1910;
  Gene Symbol: BOLL;
  Gene Name: boule-like RNA-binding prt;
  Uniprot ID:  Q8N9W6;
  ENSP ID: ENSP00000282278
MTELEYPKGSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 9361 - protein, 295 aa, Homo sapiens
  Payload ID: 1910;
  Gene Symbol: BOLL;
  Gene Name: boule-like RNA-binding prt;
  Uniprot ID:  Q8N9W6;
  ENSP ID: ENSP00000314792
METESGPQTSNQMQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 9362 - protein, 283 aa, Homo sapiens
  Payload ID: 1910;
  Gene Symbol: BOLL;
  Gene Name: boule-like RNA-binding prt;
  Uniprot ID:  Q8N9W6;
  ENSP ID: ENSP00000376116
MQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQATTQYLPGQWQWSVPQPSASSAPFLYLQPSEVIYQPVEIAQDGGCVPPPLSLMETSVPEPYSDHGVQATYHQVYAPSAITMPAPVMQPEPIKTVWSIHY

SEQ ID NO: 9363 - protein, 283 aa, Homo sapiens; identical to SEQ ID NO: 9362
  Payload ID: 1910;
  Gene Symbol: BOLL;
  Gene Name: boule-like RNA-binding prt;
  Uniprot ID:  Q8N9W6;
  ENSP ID: ENSP00000396099

SEQ ID NO: 9364 - protein, 333 aa, Homo sapiens
  Payload ID: 1910;
  Gene Symbol: BOLL;
  Gene Name: boule-like RNA-binding prt;
  ENSP ID: ENSP00000397711
MQTDSLSPSPNPVSPVPLNNPTSAPRYGTVIPNRIFVGGIDFKTNESDLRKFFSQYGSVKEVKIVNDRAGVSKGYGFVTFETQEDAQKILQEAEKLNYKDKKLNIGPAIRKQQVGIPRSSIMPAAGTMYLTTSTGYPYTYHNGVAYFHTPEVTSVPPPWPSRSVCSSPVMVAQPIYQQPAYHYQGIKQCHTRRWMDSLLPFTKCDEATTQYLPGQWQWSVPQPSASSAPFLYLQPSEVIYQPVEIAQDGGCVPPPLSLMETSVPEPYSDHGVQATYHQVYAPSAITMPAPVMQPEPIKCGAFIIKTIGQLYSSSTDFLSNDPCVAEIQLQRTS

SEQ ID NO: 9365 - protein, 87 aa, Homo sapiens
  Payload ID: 1910;
  Gene Symbol: BOLL;
  Gene Name: boule-like RNA-binding prt;
  ENSP ID: ENSP00000416911
METESGPQTSNQMQTDSLSPSPNPVSPVPLNNPTSAPRYGTVIPNRIFVGGIDFKTNESDLRKFFSQYGSVKEVKIVNDRAGVSKGF

SEQ ID NO: 9366 - protein, 256 aa, Homo sapiens
  Payload ID: 1911;
  Gene Symbol: BPIFA1;
  Gene Name: BPI fold containing family A, member 1;
  Uniprot ID:  Q9NP55;
  ENSP ID: ENSP00000346251
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 9367 - protein, 256 aa, Homo sapiens; identical to SEQ ID NO: 9366
  Payload ID: 1911;
  Gene Symbol: BPIFA1;
  Gene Name: BPI fold containing family A, member 1;
  Uniprot ID:  Q9NP55;
  ENSP ID: ENSP00000364562

SEQ ID NO: 9368 - protein, 256 aa, Homo sapiens; identical to SEQ ID NO: 9366
  Payload ID: 1911;
  Gene Symbol: BPIFA1;
  Gene Name: BPI fold containing family A, member 1;
  Uniprot ID:  Q9NP55;
  ENSP ID: ENSP00000364571

SEQ ID NO: 9369 - protein, 242 aa, Homo sapiens
  Payload ID: 1911;
  Gene Symbol: BPIFA1;
  Gene Name: BPI fold containing family A, member 1;
  Uniprot ID:  Q9NP55;
  ENSP ID: ENSP00000482297
MFQTGGLIVFYGLLAQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 9370 - protein, 249 aa, Homo sapiens
  Payload ID: 1912;
  Gene Symbol: BPIFA2;
  Gene Name: BPI fold containing family A, member 2;
  Uniprot ID:  Q96DR5;
  ENSP ID: ENSP00000253362
MLQLWKLVLLCGVLTGTSESLLDNLGNDLSNVVDKLEPVLHEGLETVDNTLKGILEKLKVDLGVLQKSSAWQLAKQKAQEAEKLLNNVISKLLPTNTDIFGLKISNSLILDVKAEPIDDGKGLNLSFPVTANVTVAGPIIGQIINLKASLDLLTAVTIETDPQTHQPVAVLGECASDPTSISLSLLDKHSQIINKFVNSVINTLKSTVSSLLQKEICPLIRIFIHSLDVNVIQQVVDNPQHKTQLQTLI

SEQ ID NO: 9371 - protein, 249 aa, Homo sapiens; identical to SEQ ID NO: 9370
  Payload ID: 1912;
  Gene Symbol: BPIFA2;
  Gene Name: BPI fold containing family A, member 2;
  Uniprot ID:  Q96DR5;
  ENSP ID: ENSP00000347012

SEQ ID NO: 9372 - protein, 218 aa, Homo sapiens
  Payload ID: 1913;
  Gene Symbol: BPIFA3;
  Gene Name: BPI fold containing family A, member 3;
  Uniprot ID:  Q9BQP9;
  ENSP ID: ENSP00000364601
MMCPLWRLLIFLGLLALPLAPHKQPWPGLAQAHRDNKSTLARIIAQGLIKHNAESRIQNIHFGDRLNASAQVAPGLVGWLISGRKHQQQQESRSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 9373 - protein, 254 aa, Homo sapiens
  Payload ID: 1913;
  Gene Symbol: BPIFA3;
  Gene Name: BPI fold containing family A, member 3;
  Uniprot ID:  Q9BQP9;
  ENSP ID: ENSP00000364603
MMCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 9374 - protein, 484 aa, Homo sapiens
  Payload ID: 1914;
  Gene Symbol: BPIFB1;
  Gene Name: BPI fold containing family B, member 1;
  Uniprot ID:  Q8TDL5;
  ENSP ID: ENSP00000253354
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPSSPVSQ

SEQ ID NO: 9375 - protein, 147 aa, Homo sapiens
  Payload ID: 1914;
  Gene Symbol: BPIFB1;
  Gene Name: BPI fold containing family B, member 1;
  ENSP ID: ENSP00000390471
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSA

SEQ ID NO: 9376 - protein, 458 aa, Homo sapiens
  Payload ID: 1915;
  Gene Symbol: BPIFB2;
  Gene Name: BPI fold containing family B, member 2;
  Uniprot ID:  Q8N4F0;
  ENSP ID: ENSP00000170150
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLRSDDNLLNTSALGRLIPEVARQFPEPMPVVLKVRLGATPVAMLHTNNATLRLQPFVEVLATASNSAFQSLFSLDVVVNLRLQLSVSKVKLQGTTSVLGDVQLTVASSNVGFIDTDQVRTLMGTVFEKPLLDHLNALLAMGIALPGVVNLHYVAPEIFVYEGYVVISSGLFYQS

SEQ ID NO: 9377 - protein, 476 aa, Homo sapiens
  Payload ID: 1916;
  Gene Symbol: BPIFB3;
  Gene Name: BPI fold containing family B, member 3;
  Uniprot ID:  P59826;
  ENSP ID: ENSP00000364643
MQPVMLALWSLLLLWGLATPCQELLETVGTLARIDKDELGKAIQNSLVGEPILQNVLGSVTAVNRGLLGSGGLLGGGGLLGHGGVFGVVEELSGLKIEELTLPKVLLKLLPGFGVQLSLHTKVGMHCSGPLGGLLQLAAEVNVTSRVALAVSSRGTPILILKRCSTLLGHISLFSGLLPTPLFGVVEQMLFKVLPGLLCPVVDSVLGVVNELLGAVLGLVSLGALGSVEFSLATLPLISNQYIELDINPIVKSVAGDIIDFPKSRAPAKVPPKKDHTSQVMVPLYLFNTTFGLLQTNGALDMDITPELVPSDVPLTTTDLAALLPEALGKLPLHQQLLLFLRVREAPTVTLHNKKALVSLPANIHVLFYVPKGTPESLFELNSVMTVRAQLAPSATKLHISLSLERLSVKVASSFTHAFDGSRLEEWLSHVVGAVYAPKLNVALDVGIPLPKVLNINFSNSVLEIVENAVVLTVAS

SEQ ID NO: 9378 - protein, 614 aa, Homo sapiens
  Payload ID: 1917;
  Gene Symbol: BPIFB4;
  Gene Name: BPI fold containing family B, member 4;
  Uniprot ID:  P59827;
  ENSP ID: ENSP00000364632
MWMAWCVAALSVVAVCGTSHETNTVLRVTKDVLSNAISGMLQQSDALHSALREVPLGVGDIPYNDFHVRGPPPVYTNGKKLDGIYQYGHIETNDNTAQLGGKYRYGEILESEGSIRDLRNSGYRSAENAYGGHRGLGRYRAAPVGRLHRRELQPGEIPPGVATGAVGPGGLLGTGGMLAADGILAGQGGLLGGGGLLGDGGLLGGGGVLGVLGEGGILSTVQGITGLRIVELTLPRVSVRLLPGVGVYLSLYTRVAINGKSLIGFLDIAVEVNITAKVRLTMDRTGYPRLVIERCDTLLGGIKVKLLRGLLPNLVDNLVNRVLADVLPDLLCPIVDVVLGLVNDQLGLVDSLIPLGILGSVQYTFSSLPLVTGEFLELDLNTLVGEAGGGLIDYPLGWPAVSPKPMPELPPMGDNTKSQLAMSANFLGSVLTLLQKQHALDLDITNGMFEELPPLTTATLGALIPKVFQQYPESCPLIIRIQVLNPPSVMLQKDKALVKVLATAEVMVSQPKDLETTICLIDVDTEFLASFSTEGDKLMIDAKLEKTSLNLRTSNVGNFDIGLMEVLVEKIFDLAFMPAMNAVLGSGVPLPKILNIDFSNADIDVLEDLLVLSA

SEQ ID NO: 9379 - protein, 44 aa, Homo sapiens
  Payload ID: 1917;
  Gene Symbol: BPIFB4;
  Gene Name: BPI fold containing family B, member 4;
  ENSP ID: ENSP00000388423
MWMAWCVAALSVVAVCGTSHETNTVLRVTKDVLSNGFSPISWTI

SEQ ID NO: 9380 - protein, 453 aa, Homo sapiens
  Payload ID: 1918;
  Gene Symbol: BPIFB6;
  Gene Name: BPI fold containing family B, member 6;
  Uniprot ID:  Q8NFQ5;
  ENSP ID: ENSP00000344929
MLRILCLALCSLLTGTRADPGALLRLGMDIMNQVQSAMDESHILEKMAAEAGKKQPGMKPIKGITNLKVKDVQLPVITLNFVPGVGIFQCVSTGMTVTGKSFMGGNMEIIVALNITATNRLLRDEETGLPVFKSEGCEVILVNVKTNLPSNMLPKMVNKFLDSTLHKVLPGLMCPAIDAVLVYVNRKWTNLSDPMPVGQMGTVKYVLMSAPATTASYIQLDFSPVVQQQKGKTIKLADAGEALTFPEGYAKGSSQLLLPATFLSAELALLQKSFHVNIQDTMIGELPPQTTKTLARFIPEVAVAYPKSKPLTTQIKIKKPPKVTMKTGKSLLHLHSTLEMFAARWRSKAPMSLFLLEVHFNLKVQYSVHENQLQMATSLDRLLSLSRKSSSIGNFNERELTGFITSYLEEAYIPVVNDVLQVGLPLPDFLAMNYNLAELDIVENALMLDLKLG

SEQ ID NO: 9381 - protein, 88 aa, Homo sapiens
  Payload ID: 1918;
  Gene Symbol: BPIFB6;
  Gene Name: BPI fold containing family B, member 6;
  ENSP ID: ENSP00000443533
MLRILCLALCSLLTGTRADPGALLRLGMDIMNREVQSAMDESHILEKMAAEAGKKQPGMKPIKGITNEQGHFEEEMRLESQISTLHAT

SEQ ID NO: 9382 - protein, 507 aa, Homo sapiens
  Payload ID: 1919;
  Gene Symbol: BPIFC;
  Gene Name: BPI fold containing family C;
  Uniprot ID:  Q8NFQ6;
  ENSP ID: ENSP00000300399
MCTKTIPVLWGCFLLWNLYVSSSQTIYPGIKARITQRALDYGVQAGMKMIEQMLKEKKLPDLSGSESLEFLKVDYVNYNFSNIKISAFSFPNTSLAFVPGVGIKALTNHGTANISTDWGFESPLFQDTGGADLFLSGVYFTGIIILTRNDFGHPTLKLQDCYAQLSHAHVSFSGELSVLYNSFAEPMEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNVTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 9383 - protein, 82 aa, Homo sapiens
  Payload ID: 1919;
  Gene Symbol: BPIFC;
  Gene Name: BPI fold containing family C;
  ENSP ID: ENSP00000380592
MCTKTIPVLWGCFLLWNLYVSSSQTIYPGIKARITQRALDYGVQAGMKMIEQMLKEKKLPDLSGSESLEFLKVDYVNYNFSK

SEQ ID NO: 9384 - protein, 507 aa, Homo sapiens; identical to SEQ ID NO: 9382
  Payload ID: 1919;
  Gene Symbol: BPIFC;
  Gene Name: BPI fold containing family C;
  Uniprot ID:  Q8NFQ6;
  ENSP ID: ENSP00000380594

SEQ ID NO: 9385 - protein, 264 aa, Homo sapiens
  Payload ID: 1919;
  Gene Symbol: BPIFC;
  Gene Name: BPI fold containing family C;
  Uniprot ID:  Q8NFQ6;
  ENSP ID: ENSP00000439123
MEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNVTLSTEEISNHFVQNSQGLGNVLSRVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 9386 - protein, 778 aa, Homo sapiens
  Payload ID: 1920;
  Gene Symbol: BRSK1;
  Gene Name: BR serine/threonine kinase 1;
  Uniprot ID:  Q8TDC3;
  ENSP ID: ENSP00000310649
MSSGAKEGGGGSPAYHLPHPHPHPPQHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 9387 - protein, 473 aa, Homo sapiens
  Payload ID: 1920;
  Gene Symbol: BRSK1;
  Gene Name: BR serine/threonine kinase 1;
  ENSP ID: ENSP00000320853
MRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 9388 - protein, 131 aa, Homo sapiens
  Payload ID: 1920;
  Gene Symbol: BRSK1;
  Gene Name: BR serine/threonine kinase 1;
  ENSP ID: ENSP00000466380
MRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGA

SEQ ID NO: 9389 - protein, 63 aa, Homo sapiens
  Payload ID: 1920;
  Gene Symbol: BRSK1;
  Gene Name: BR serine/threonine kinase 1;
  ENSP ID: ENSP00000466755
  MOD_RES (1)..(1): Any amino acid
XAGLVKLGVHCITGQKVAIKIVNREKLSESVLMKVEREIAILKLIEHPHVLKLHDVYENKKYL

SEQ ID NO: 9390 - protein, 343 aa, Homo sapiens
  Payload ID: 1920;
  Gene Symbol: BRSK1;
  Gene Name: BR serine/threonine kinase 1;
  Uniprot ID:  Q8TDC3;
  ENSP ID: ENSP00000467357
MSSGAKEGGGGSPAYHLPHPHPHPPQHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEE

SEQ ID NO: 9391 - protein, 794 aa, Homo sapiens
  Payload ID: 1920;
  Gene Symbol: BRSK1;
  Gene Name: BR serine/threonine kinase 1;
  Uniprot ID:  Q8TDC3;
  ENSP ID: ENSP00000468190
MVAGLTLGKGPESPDGDVSVPERKDEVAGGGGEEEEAEERGRHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 9392 - protein, 668 aa, Homo sapiens
  Payload ID: 1921;
  Gene Symbol: BRSK2;
  Gene Name: BR serine/threonine kinase 2;
  Uniprot ID:  Q8IWQ3;
  ENSP ID: ENSP00000310697
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGIIPKS

SEQ ID NO: 9393 - protein, 766 aa, Homo sapiens
  Payload ID: 1921;
  Gene Symbol: BRSK2;
  Gene Name: BR serine/threonine kinase 2;
  Uniprot ID:  Q8IWQ3;
  ENSP ID: ENSP00000371614
MSPEGHPSRWARPRRPCICPSSLCSPREPRSGPAVGRGGAAHHRVPAGHTPGPQLLQPHLHLPQGQTWLCLQPSPAGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCDEKNGQAAQAPSTPAKRSAHGPLGDSAAAGPGPGGDAEYPTGKDTAKMGPPTARREQP

SEQ ID NO: 9394 - protein, 674 aa, Homo sapiens
  Payload ID: 1921;
  Gene Symbol: BRSK2;
  Gene Name: BR serine/threonine kinase 2;
  Uniprot ID:  Q8IWQ3;
  ENSP ID: ENSP00000431152
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 9395 - protein, 736 aa, Homo sapiens
  Payload ID: 1921;
  Gene Symbol: BRSK2;
  Gene Name: BR serine/threonine kinase 2;
  Uniprot ID:  Q8IWQ3;
  ENSP ID: ENSP00000432000
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGSPLSNFFDVIKQLFSDEKNGQAAQAPSTPAKRSAHGPLGDSAAAGPGPGGDAEYPTGKDTAKMGPPTARREQP

SEQ ID NO: 9396 - protein, 170 aa, Homo sapiens
  Payload ID: 1921;
  Gene Symbol: BRSK2;
  Gene Name: BR serine/threonine kinase 2;
  ENSP ID: ENSP00000432252
  MOD_RES (1)..(1): Any amino acid
XEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTRGQE

SEQ ID NO: 9397 - protein, 130 aa, Homo sapiens
  Payload ID: 1921;
  Gene Symbol: BRSK2;
  Gene Name: BR serine/threonine kinase 2;
  ENSP ID: ENSP00000432672
MKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGE

SEQ ID NO: 9398 - protein, 614 aa, Homo sapiens
  Payload ID: 1921;
  Gene Symbol: BRSK2;
  Gene Name: BR serine/threonine kinase 2;
  Uniprot ID:  Q8IWQ3;
  ENSP ID: ENSP00000433235
MKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 9399 - protein, 696 aa, Homo sapiens
  Payload ID: 1921;
  Gene Symbol: BRSK2;
  Gene Name: BR serine/threonine kinase 2;
  Uniprot ID:  Q8IWQ3;
  ENSP ID: ENSP00000433370
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQSKAMFSKSLDIAEAHPQFSKEDRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 9400 - protein, 674 aa, Homo sapiens; identical to SEQ ID NO: 9394
  Payload ID: 1921;
  Gene Symbol: BRSK2;
  Gene Name: BR serine/threonine kinase 2;
  Uniprot ID:  Q8IWQ3;
  ENSP ID: ENSP00000433684

SEQ ID NO: 9401 - protein, 86 aa, Homo sapiens
  Payload ID: 1921;
  Gene Symbol: BRSK2;
  Gene Name: BR serine/threonine kinase 2;
  ENSP ID: ENSP00000434075
MKVEREIAILKLIEHPHVLKLHDVYENKKYLYLVLEHVSGGELFDYLVKKGRLTPKEARKFFRQIISALDFCHSHSICHRDLKPEN

SEQ ID NO: 9402 - protein, 200 aa, Homo sapiens
  Payload ID: 1921;
  Gene Symbol: BRSK2;
  Gene Name: BR serine/threonine kinase 2;
  ENSP ID: ENSP00000436474
  MOD_RES (1)..(1): Any amino acid
XTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSK

SEQ ID NO: 9403 - protein, 170 aa, Homo sapiens
  Payload ID: 1921;
  Gene Symbol: BRSK2;
  Gene Name: BR serine/threonine kinase 2;
  ENSP ID: ENSP00000445168
MSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 9404 - protein, 353 aa, Homo sapiens
  Payload ID: 1922;
  Gene Symbol: BDKRB1;
  Gene Name: bradykinin receptor B1;
  Uniprot ID:  P46663;
  ENSP ID: ENSP00000216629
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTRCGGRKDSKTTALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 9405 - protein, 284 aa, Homo sapiens
  Payload ID: 1922;
  Gene Symbol: BDKRB1;
  Gene Name: bradykinin receptor B1;
  ENSP ID: ENSP00000452064
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTSSLNPVIYVFVGRLFRTKPALSRWLIKILSRSCKNQSHTREERAGR

SEQ ID NO: 9406 - protein, 353 aa, Homo sapiens; identical to SEQ ID NO: 9404
  Payload ID: 1922;
  Gene Symbol: BDKRB1;
  Gene Name: bradykinin receptor B1;
  Uniprot ID:  P46663;
  ENSP ID: ENSP00000479276

SEQ ID NO: 9407 - protein, 364 aa, Homo sapiens
  Payload ID: 1923;
  Gene Symbol: BDKRB2;
  Gene Name: bradykinin receptor B2;
  Uniprot ID:  P30411;
  ENSP ID: ENSP00000438376
MLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 9408 - protein, 364 aa, Homo sapiens; identical to SEQ ID NO: 9407
  Payload ID: 1923;
  Gene Symbol: BDKRB2;
  Gene Name: bradykinin receptor B2;
  Uniprot ID:  P30411;
  ENSP ID: ENSP00000439459

SEQ ID NO: 9409 - protein, 391 aa, Homo sapiens
  Payload ID: 1923;
  Gene Symbol: BDKRB2;
  Gene Name: bradykinin receptor B2;
  Uniprot ID:  P30411;
  ENSP ID: ENSP00000450482
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 9410 - protein, 766 aa, Homo sapiens [sequence omitted]

SEQ ID NO: 9411 - protein, 102 aa, Homo sapiens
  Payload ID: 1924;
  Gene Symbol: BRAF;
  Gene Name: B-Raf proto-oncogene, serine/threonine kinase;
  ENSP ID: ENSP00000418033
IHRDLKSNNIFLHEDLTVKIGDFGLATVKSRWSGSHQFEQLSGSILWMAPEVIRMQDKNPYSFQSDVYAFGIVLYELMTGQLPYSNINNRDQVLCPPWEYNK

SEQ ID NO: 9412 - protein, 375 aa, Homo sapiens
  Payload ID: 1924;
  Gene Symbol: BRAF;
  Gene Name: B-Raf proto-oncogene, serine/threonine kinase;
  ENSP ID: ENSP00000419060
  MOD_RES (1)..(1): Any amino acid
XSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQIIFMVGRGYLSPDLSKVRSNCPKAMKRLMAECLKKKRDERPLFPQILASIELLARSLPKIHRSASEPSLNRAGFQTEDFSLYACASPKTPIQAGGYGEFAAFK

SEQ ID NO: 9413 - protein, 194 aa, Homo sapiens
  Payload ID: 1924;
  Gene Symbol: BRAF;
  Gene Name: B-Raf proto-oncogene, serine/threonine kinase;
  ENSP ID: ENSP00000420119
QALFNGDMEPEAGAGAGAAASSAADPAIPEEVWNIKQMIKLTQEHIEALLDKFGGEHNPPSIYLEAYEEYTSKLDALQQREQQLLESLGNGTDFSVSSSASMDTVTSSSSSSLSVLPSSLSVFQNPTDVARSNPKSPQKPIVRVFLPNKQRTVVPARCGVTVRDSLKKALMMRGLIPECCAVYRIQDGSFLELT

SEQ ID NO: 9414 - protein, 227 aa, Homo sapiens
  Payload ID: 1925;
  Gene Symbol: BASP1;
  Gene Name: brain abundant, membrane attached signal prt 1;
  Uniprot ID:  P80723;
  ENSP ID: ENSP00000319281
MGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 9415 - protein, 45 aa, Homo sapiens
  Payload ID: 1925;
  Gene Symbol: BASP1;
  Gene Name: brain abundant, membrane attached signal prt 1;
  ENSP ID: ENSP00000476090
MGGKLSKKKKGYNVNDEKAKEKDKKAEGAATEEEGTPKESEPQAA

SEQ ID NO: 9416 - protein, 227 aa, Homo sapiens; identical to SEQ ID NO: 9414
  Payload ID: 1925;
  Gene Symbol: BASP1;
  Gene Name: brain abundant, membrane attached signal prt 1;
  Uniprot ID:  P80723;
  ENSP ID: ENSP00000482066

SEQ ID NO: 9417 - protein, 180 aa, Homo sapiens
  Payload ID: 1926;
  Gene Symbol: BAALC;
  Gene Name: brain and acute leukemia, cytoplasmic;
  Uniprot ID:  Q8WXS3;
  ENSP ID: ENSP00000297574
MGCGGSRADAIEPRYYESWTRETESTWLTYTDSDAPPSAAAPDSGPEAGGLHSVLEAEKSKIKAPTDSVSDEGLFSASKMAPLAVFSHGMLEDGLPSNGVPRSTAPGGIPNPEKKTNCETQCPNPQSLSSGPLTQKQNGLQTTEAKRDAKRMPAKEVTINVTDSIQQMDRSRRITKNCVN

SEQ ID NO: 9418 - protein, 80 aa, Homo sapiens
  Payload ID: 1926;
  Gene Symbol: BAALC;
  Gene Name: brain and acute leukemia, cytoplasmic;
  Uniprot ID:  Q8WXS3;
  ENSP ID: ENSP00000302559
MGCGGSRADAIEPRYYESWTRETESTWLTYTDSDAPPSAAAPDSGPEAGGLHSAHYPLAFALAWRDNSLGALLVQEGLCR

SEQ ID NO: 9419 - protein, 145 aa, Homo sapiens
  Payload ID: 1926;
  Gene Symbol: BAALC;
  Gene Name: brain and acute leukemia, cytoplasmic;
  Uniprot ID:  Q8WXS3;
  ENSP ID: ENSP00000312457
MGCGGSRADAIEPRYYESWTRETESTWLTYTDSDAPPSAAAPDSGPEAGGLHSGMLEDGLPSNGVPRSTAPGGIPNPEKKTNCETQCPNPQSLSSGPLTQKQNGLQTTEAKRDAKRMPAKEVTINVTDSIQQMDRSRRITKNCVN

SEQ ID NO: 9420 - protein, 73 aa, Homo sapiens
  Payload ID: 1926;
  Gene Symbol: BAALC;
  Gene Name: brain and acute leukemia, cytoplasmic;
  Uniprot ID:  Q8WXS3;
  ENSP ID: ENSP00000331579
MGCGGSRADAIEPRYYESWTRETESTWLTYTDSDAPPSAAAPDSGPEAGGLHSGCLEEHYHLTALQKVGHPNH

SEQ ID NO: 9421 - protein, 54 aa, Homo sapiens
  Payload ID: 1926;
  Gene Symbol: BAALC;
  Gene Name: brain and acute leukemia, cytoplasmic;
  Uniprot ID:  Q8WXS3;
  ENSP ID: ENSP00000395024
MGCGGSRADAIEPRYYESWTRETESTWLTYTDSDAPPSAAAPDSGPEAGGLHSG

SEQ ID NO: 9422 - protein, 383 aa, Homo sapiens
  Payload ID: 1927;
  Gene Symbol: BRE;
  Gene Name: brain and reproductive organ-expressed (TNFRSF1A modulator);
  Uniprot ID:  Q9NXR7;
  ENSP ID: ENSP00000339371
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 9423 - protein, 415 aa, Homo sapiens
  Payload ID: 1927;
  Gene Symbol: BRE;
  Gene Name: brain and reproductive organ-expressed (TNFRSF1A modulator);
  Uniprot ID:  Q9NXR7;
  ENSP ID: ENSP00000343412
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGCQGSRDACSPWEQVLAFAVAKTGCKLLQPQRNWPSSRGPPWRASEGERTAQ

SEQ ID NO: 9424 - protein, 376 aa, Homo sapiens
  Payload ID: 1927;
  Gene Symbol: BRE;
  Gene Name: brain and reproductive organ-expressed (TNFRSF1A modulator);
  Uniprot ID:  Q9NXR7;
  ENSP ID: ENSP00000354699
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKRESNRDGEESSSA

SEQ ID NO: 9425 - protein, 383 aa, Homo sapiens; identical to SEQ ID NO: 9422
  Payload ID: 1927;
  Gene Symbol: BRE;
  Gene Name: brain and reproductive organ-expressed (TNFRSF1A modulator);
  Uniprot ID:  Q9NXR7;
  ENSP ID: ENSP00000368945

SEQ ID NO: 9426 - protein, 284 aa, Homo sapiens
  Payload ID: 1927;
  Gene Symbol: BRE;
  Gene Name: brain and reproductive organ-expressed (TNFRSF1A modulator);
  ENSP ID: ENSP00000368950
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEQLSLSPCHTDFLLTRFLPAPLWGSEVSVPSGPFHLLIILPQPLSGLVRPCLLFSQPCS

SEQ ID NO: 9427 - protein, 376 aa, Homo sapiens; identical to SEQ ID NO: 9424
  Payload ID: 1927;
  Gene Symbol: BRE;
  Gene Name: brain and reproductive organ-expressed (TNFRSF1A modulator);
  Uniprot ID:  Q9NXR7;
  ENSP ID: ENSP00000368953

SEQ ID NO: 9428 - protein, 153 aa, Homo sapiens
  Payload ID: 1927;
  Gene Symbol: BRE;
  Gene Name: brain and reproductive organ-expressed (TNFRSF1A modulator);
  ENSP ID: ENSP00000392345
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGE

SEQ ID NO: 9429 - protein, 166 aa, Homo sapiens
  Payload ID: 1927;
  Gene Symbol: BRE;
  Gene Name: brain and reproductive organ-expressed (TNFRSF1A modulator);
  ENSP ID: ENSP00000474342
VRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWVRIFENGKKDDFIHNKIINSYV

SEQ ID NO: 9430 - protein, 128 aa, Homo sapiens
  Payload ID: 1928;
  Gene Symbol: BEX2;
  Gene Name: brain expressed X-linked 2;
  Uniprot ID:  Q9BXY8;
  ENSP ID: ENSP00000361759
MESKEERALNNLIVENVNQENDEKDEKEQVANKGEPLALPLNVSEYCVPRGNRRRFRVRQPILQYRWDIMHRLGEPQARMREENMERIGEEVRQLMEKLREKQLSHSLRAVSTDPPHHDHHDEFCLMP

SEQ ID NO: 9431 - protein, 128 aa, Homo sapiens; identical to SEQ ID NO: 9430
  Payload ID: 1928;
  Gene Symbol: BEX2;
  Gene Name: brain expressed X-linked 2;
  Uniprot ID:  Q9BXY8;
  ENSP ID: ENSP00000361762

SEQ ID NO: 9432 - protein, 101 aa, Homo sapiens
  Payload ID: 1928;
  Gene Symbol: BEX2;
  Gene Name: brain expressed X-linked 2;
  ENSP ID: ENSP00000394915
MESKEERALNNLIVENVNQENDEKDEKEQVANKGEPLALPLNVSEYCVPRGNRRRFRVRQPILQYRWDIMHRLGEPQARMREENMERIGEEVRQLMEKLRE

SEQ ID NO: 9433 - protein, 160 aa, Homo sapiens
  Payload ID: 1928;
  Gene Symbol: BEX2;
  Gene Name: brain expressed X-linked 2;
  Uniprot ID:  Q9BXY8;
  ENSP ID: ENSP00000442521
MQKMVVCGAKCCGDAPHVENREEETARIGPGVMESKEERALNNLIVENVNQENDEKDEKEQVANKGEPLALPLNVSEYCVPRGNRRRFRVRQPILQYRWDIMHRLGEPQARMREENMERIGEEVRQLMEKLREKQLSHSLRAVSTDPPHHDHHDEFCLMP

SEQ ID NO: 9434 - protein, 150 aa, Homo sapiens
  Payload ID: 1929;
  Gene Symbol: BEAN1;
  Gene Name: brain expressed, associated with NEDD4, 1;
  Uniprot ID:  Q3B7T3;
  ENSP ID: ENSP00000299694
MRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 9435 - protein, 259 aa, Homo sapiens
  Payload ID: 1929;
  Gene Symbol: BEAN1;
  Gene Name: brain expressed, associated with NEDD4, 1;
  Uniprot ID:  Q3B7T3;
  ENSP ID: ENSP00000442793
MSFKRPCPLARYNRTSYFYPTFSESSEHSHLLVSPVLVASAVIGVVIILSCITIIVGSIRRDRQARLQRHRHRHHRHHHHHHHHRRRRHREYEHGYVSDEHTYSRSSRRMRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 9436 - protein, 208 aa, Homo sapiens
  Payload ID: 1929;
  Gene Symbol: BEAN1;
  Gene Name: brain expressed, associated with NEDD4, 1;
  Uniprot ID:  Q3B7T3;
  ENSP ID: ENSP00000455212
MRYACSSSEDWPPPLDISSDGDVDATVLRELYPDSPPGVSLSRLRWSAMMYTGSFTYWVRSMLSRHKLDAILGRLGYTATLESEFSLVQAISKENVKQMVFKIFLVRVSCEAVLRTAGTRMLEPGTEKLARTHSRHSSEKRLVKPCSCLEGVQPGPGSGGPQQGPSEGVGSETALAEGTAGQRSLPMALSPSEVSTAPNSLPSGSPVL

SEQ ID NO: 9437 - protein, 72 aa, Homo sapiens
  Payload ID: 1929;
  Gene Symbol: BEAN1;
  Gene Name: brain expressed, associated with NEDD4, 1;
  ENSP ID: ENSP00000456430
MRYACSSSEDWPPPLDISSDGDVDATVLRELYPDSPPGQGLTQSPTLECNGMNIAHCSLELLGSSDPPTSAS

SEQ ID NO: 9438 - protein, 150 aa, Homo sapiens; identical to SEQ ID NO: 9434
  Payload ID: 1929;
  Gene Symbol: BEAN1;
  Gene Name: brain expressed, associated with NEDD4, 1;
  Uniprot ID:  Q3B7T3;
  ENSP ID: ENSP00000456822

SEQ ID NO: 9439 - protein, 82 aa, Homo sapiens
  Payload ID: 1929;
  Gene Symbol: BEAN1;
  Gene Name: brain expressed, associated with NEDD4, 1;
  ENSP ID: ENSP00000462088
  MOD_RES (1)..(1): Any amino acid
XPLDISSDGDVDATVLRELYPDSPPGCTLGALPTGCDLCFPDTNWTPSWAGWATRPPWSLSSHWSRPSAKRMSSRWCSRSSW

SEQ ID NO: 9440 - protein, 113 aa, Homo sapiens
  Payload ID: 1929;
  Gene Symbol: BEAN1;
  Gene Name: brain expressed, associated with NEDD4, 1;
  ENSP ID: ENSP00000477843
MSFKRPCPCKFPPHILPPLGARQGQSLESSCRERLEVFGQRTAGVQPEANVACWVGRGQHGRPLTSARCSLRTENRTLAHSSVSALPEVWIGVPLRDVNGMTHTHTQIKDYMA

SEQ ID NO: 9441 - protein, 208 aa, Homo sapiens; identical to SEQ ID NO: 9436
  Payload ID: 1929;
  Gene Symbol: BEAN1;
  Gene Name: brain expressed, associated with NEDD4, 1;
  Uniprot ID:  Q3B7T3;
  ENSP ID: ENSP00000483700

SEQ ID NO: 9442 - protein, 125 aa, Homo sapiens
  Payload ID: 1930;
  Gene Symbol: BEX1;
  Gene Name: brain expressed, X-linked 1;
  Uniprot ID:  Q9HBH7;
  ENSP ID: ENSP00000361813
MESKEKRAVNSLSMENANQENEEKEQVANKGEPLALPLDAGEYCVPRGNRRRFRVRQPILQYRWDMMHRLGEPQARMREENMERIGEEVRQLMEKLREKQLSHSLRAVSTDPPHHDHHDEFCLMP

SEQ ID NO: 9443 - protein, 120 aa, Homo sapiens
  Payload ID: 1931;
  Gene Symbol: BEX4;
  Gene Name: brain expressed, X-linked 4;
  Uniprot ID:  Q9NWD9;
  ENSP ID: ENSP00000361776
MESKEELAANNLNGENAQQENEGGEQAPTQNEEESRHLGGGEGQKPGGNIRRGRVRRLVPNFRWAIPNRHIEHNEARDDVERFVGQMMEIKRKTREQQMRHYMRFQTPEPDNHYDFCLIP

SEQ ID NO: 9444 - protein, 120 aa, Homo sapiens; identical to SEQ ID NO: 9443
  Payload ID: 1931;
  Gene Symbol: BEX4;
  Gene Name: brain expressed, X-linked 4;
  Uniprot ID:  Q9NWD9;
  ENSP ID: ENSP00000361780

SEQ ID NO: 9445 - protein, 111 aa, Homo sapiens
  Payload ID: 1932;
  Gene Symbol: BEX5;
  Gene Name: brain expressed, X-linked 5;
  Uniprot ID:  Q5H9J7;
  ENSP ID: ENSP00000328030
MENVPKENKVVEKAPVQNEAPALGGGEYQEPGGNVKGVWAPPAPGFGEDVPNRLVDNIDMIDGDGDDMERFMEEMRELRRKIRELQLRYSLRILIGDPPHHDHHDEFCLMP

SEQ ID NO: 9446 - protein, 111 aa, Homo sapiens; identical to SEQ ID NO: 9445
  Payload ID: 1932;
  Gene Symbol: BEX5;
  Gene Name: brain expressed, X-linked 5;
  Uniprot ID:  Q5H9J7;
  ENSP ID: ENSP00000446054

SEQ ID NO: 9447 - protein, 125 aa, Homo sapiens
  Payload ID: 1933;
  Gene Symbol: BRI3;
  Gene Name: brain prt I3;
  Uniprot ID:  O95415;
  ENSP ID: ENSP00000297290
MDHKPLLQERPPAYNLEAGQGDYACGPHGYGAIPAAPPPPPYPYLVTGIPTHHPRVYNIHSRTVTRYPANSIVVVGGCPVCRVGVLEDCFTFLGIFLAIILFPFGFICCFALRKRRCPNCGATFA

SEQ ID NO: 9448 - protein, 98 aa, Homo sapiens
  Payload ID: 1933;
  Gene Symbol: BRI3;
  Gene Name: brain prt I3;
  ENSP ID: ENSP00000440936
MDHKPLLQERPPAYNLEAGQGDYACGPHGYGAIPAAPPPPPYPYLVTGIPTHHPRVYNIHSRTVTRYPANSIVVVGGCPVCRHQRSSWLYTYPLRVCT

SEQ ID NO: 9449 - protein, 47 aa, Homo sapiens
  Payload ID: 1933;
  Gene Symbol: BRI3;
  Gene Name: brain prt I3;
  ENSP ID: ENSP00000459133
IHSRTVTRYPANSIVVVGGCPVCSNFVYDDGNQPLLPAKREKRPYQQ

SEQ ID NO: 9450 - protein, 255 aa, Homo sapiens
  Payload ID: 1934;
  Gene Symbol: BDNF;
  Gene Name: brain-derived neurotrophic factor;
  Uniprot ID:  P23560;
  ENSP ID: ENSP00000320002
MFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 9451 - protein, 247 aa, Homo sapiens
  Payload ID: 1934;
  Gene Symbol: BDNF;
  Gene Name: brain-derived neurotrophic factor;
  Uniprot ID:  P23560;
  ENSP ID: ENSP00000349084
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 9452 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000379302

SEQ ID NO: 9453 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000379304

SEQ ID NO: 9454 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000379305

SEQ ID NO: 9455 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000379307

SEQ ID NO: 9456 - protein, 262 aa, Homo sapiens
  Payload ID: 1934;
  Gene Symbol: BDNF;
  Gene Name: brain-derived neurotrophic factor;
  Uniprot ID:  P23560;
  ENSP ID: ENSP00000379309
MQSREEEWFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 9457 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000389345

SEQ ID NO: 9458 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000389564

SEQ ID NO: 9459 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000400502

SEQ ID NO: 9460 - protein, 329 aa, Homo sapiens
  Payload ID: 1934;
  Gene Symbol: BDNF;
  Gene Name: brain-derived neurotrophic factor;
  Uniprot ID:  P23560;
  ENSP ID: ENSP00000414303
MCGATSFLHECTRLILVTTQNAEFLQKGLQVHTCFGVYPHASVWHDCASQKKGCAVYLHVSVEFNKLIPENGFIKFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 9461 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000432035

SEQ ID NO: 9462 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000432376

SEQ ID NO: 9463 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000432727

SEQ ID NO: 9464 - protein, 77 aa, Homo sapiens
  Payload ID: 1934;
  Gene Symbol: BDNF;
  Gene Name: brain-derived neurotrophic factor;
  ENSP ID: ENSP00000433003
MCGATSFLHECTRLILVTTQNAEFLQKGLQVHTCFGVYPHASVWHDCASQKKGCAVYLHVSVEFNKLIPENGFIKGW

SEQ ID NO: 9465 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000435564

SEQ ID NO: 9466 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000435805

SEQ ID NO: 9467 - protein, 247 aa, Homo sapiens; identical to SEQ ID NO: 9451
  Payload ID: 1934;
  Gene Symbol: BDNF;
  Gene Name: brain-derived neurotrophic factor;
  Uniprot ID:  P23560;
  ENSP ID: ENSP00000437138

SEQ ID NO: 9468 - protein, 593 aa, Homo sapiens
  Payload ID: 1935;
  Gene Symbol: BEGAIN;
  Gene Name: brain-enriched guanylate kinase-associated;
  Uniprot ID:  Q9BUH8;
  ENSP ID: ENSP00000347301
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 9469 - protein, 593 aa, Homo sapiens; identical to SEQ ID NO: 9468
  Payload ID: 1935;
  Gene Symbol: BEGAIN;
  Gene Name: brain-enriched guanylate kinase-associated;
  Uniprot ID:  Q9BUH8;
  ENSP ID: ENSP00000411124

SEQ ID NO: 9470 - protein, 167 aa, Homo sapiens
  Payload ID: 1935;
  Gene Symbol: BEGAIN;
  Gene Name: brain-enriched guanylate kinase-associated;
  ENSP ID: ENSP00000450722
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPS

SEQ ID NO: 9471 - protein, 169 aa, Homo sapiens
  Payload ID: 1935;
  Gene Symbol: BEGAIN;
  Gene Name: brain-enriched guanylate kinase-associated;
  ENSP ID: ENSP00000451125
MWTGGRRPGRLRRAASAADMEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDF

SEQ ID NO: 9472 - protein, 529 aa, Homo sapiens
  Payload ID: 1935;
  Gene Symbol: BEGAIN;
  Gene Name: brain-enriched guanylate kinase-associated;
  ENSP ID: ENSP00000451380
MALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 9473 - protein, 299 aa, Homo sapiens
  Payload ID: 1935;
  Gene Symbol: BEGAIN;
  Gene Name: brain-enriched guanylate kinase-associated;
  ENSP ID: ENSP00000451397
MPSPSDCASAADMEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAF

SEQ ID NO: 9474 - protein, 287 aa, Homo sapiens
  Payload ID: 1935;
  Gene Symbol: BEGAIN;
  Gene Name: brain-enriched guanylate kinase-associated;
  ENSP ID: ENSP00000452157
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAF

SEQ ID NO: 9475 - protein, 174 aa, Homo sapiens
  Payload ID: 1935;
  Gene Symbol: BEGAIN;
  Gene Name: brain-enriched guanylate kinase-associated;
  ENSP ID: ENSP00000452607
MALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEE

SEQ ID NO: 9476 - protein, 233 aa, Homo sapiens
  Payload ID: 1936;
  Gene Symbol: BSX;
  Gene Name: brain-specific homeobox;
  Uniprot ID:  Q3C1V8;
  ENSP ID: ENSP00000344285
MNLNFTSPLHPASSQRPTSFFIEDILLHKPKPLREVAPDHFASSLASRVPLLDYGYPLMPTPTLLAPHAHHPLHKGDHHHPYFLTTSGMPVPALFPHPQHAELPGKHCRRRKARTVFSDSQLSGLEKRFEIQRYLSTPERVELATALSLSETQVKTWFQNRRMKHKKQLRKSQDEPKAPDGPESPEGSPRGSEAATAAEARLSLPAGPFVLTEPEDEVDIGDEGELGSGPHVL

SEQ ID NO: 9477 - protein, 386 aa, Homo sapiens
  Payload ID: 1937;
  Gene Symbol: BCAT1;
  Gene Name: branched chain amino-acid transaminase 1, cytosolic;
  Uniprot ID:  P54687;
  ENSP ID: ENSP00000261192
MKDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 9478 - protein, 325 aa, Homo sapiens
  Payload ID: 1937;
  Gene Symbol: BCAT1;
  Gene Name: branched chain amino-acid transaminase 1, cytosolic;
  Uniprot ID:  P54687;
  ENSP ID: ENSP00000339805
MKAKDLIVTPATILKEKPDPNNLVFGTVFTDHMLTVEWSSEFGWEKPHIKPLQNLSLHPGSSALHYAVEVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 9479 - protein, 144 aa, Homo sapiens
  Payload ID: 1937;
  Gene Symbol: BCAT1;
  Gene Name: branched chain amino-acid transaminase 1, cytosolic;
  ENSP ID: ENSP00000438593
MKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIG

SEQ ID NO: 9480 - protein, 385 aa, Homo sapiens
  Payload ID: 1937;
  Gene Symbol: BCAT1;
  Gene Name: branched chain amino-acid transaminase 1, cytosolic;
  Uniprot ID:  P54687;
  ENSP ID: ENSP00000440817
MDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 9481 - protein, 349 aa, Homo sapiens
  Payload ID: 1937;
  Gene Symbol: BCAT1;
  Gene Name: branched chain amino-acid transaminase 1, cytosolic;
  Uniprot ID:  P54687;
  ENSP ID: ENSP00000440827
MKDCSNGCSAECTGEGGSKEVVGTFKAKDLIVTPATILKEKPDPNNLVFGTVFTDHMLTVEWSSEFGWEKPHIKPLQNLSLHPGSSALHYAVEVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 9482 - protein, 398 aa, Homo sapiens
  Payload ID: 1937;
  Gene Symbol: BCAT1;
  Gene Name: branched chain amino-acid transaminase 1, cytosolic;
  Uniprot ID:  P54687;
  ENSP ID: ENSP00000443459
MASPLRSAAALARQDCSNGCSAECTGEGGSKEVVGTFKAKDLIVTPATILKEKPDPNNLVFGTVFTDHMLTVEWSSEFGWEKPHIKPLQNLSLHPGSSALHYAVELFEGLKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWGEFKVSERYLTMDDLTTALEGNRVREMFGSGTACVVCPVSDILYKGETIHIPTMENGPKLASRILSKLTDIQYGREESDWTIVLS

SEQ ID NO: 9483 - protein, 225 aa, Homo sapiens
  Payload ID: 1937;
  Gene Symbol: BCAT1;
  Gene Name: branched chain amino-acid transaminase 1, cytosolic;
  ENSP ID: ENSP00000481749
  MOD_RES (1)..(1): Any amino acid
XKAFRGVDNKIRLFQPNLNMDRMYRSAVRATLPVFDKEELLECIQQLVKLDQEWVPYSTSASLYIRPTFIGTEPSLGVKKPTKALLFVLLSPVGPYFSSGTFNPVSLWANPKYVRAWKGGTGDCKMGGNYGSSLFAQCEAVDNGCQQVLWLYGEDHQITEVGTMNLFLYWINEDGEEELATPPLDGIILPGVTRRCILDLAHQWVGAFDMNNFCKPEIKNNQNKP

SEQ ID NO: 9484 - protein, 392 aa, Homo sapiens
  Payload ID: 1938;
  Gene Symbol: BCAT2;
  Gene Name: branched chain amino-acid transaminase 2, mitochondrial;
  Uniprot ID:  O15382;
  ENSP ID: ENSP00000322991
MAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 9485 - protein, 352 aa, Homo sapiens
  Payload ID: 1938;
  Gene Symbol: BCAT2;
  Gene Name: branched chain amino-acid transaminase 2, mitochondrial;
  ENSP ID: ENSP00000385161
MTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 9486 - protein, 300 aa, Homo sapiens
  Payload ID: 1938;
  Gene Symbol: BCAT2;
  Gene Name: branched chain amino-acid transaminase 2, mitochondrial;
  Uniprot ID:  O15382;
  ENSP ID: ENSP00000440973
MAAAALGQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYGIRAHEWMFPV

SEQ ID NO: 9487 - protein, 445 aa, Homo sapiens
  Payload ID: 1938;
  Gene Symbol: BCAT2;
  Gene Name: branched chain amino-acid transaminase 2, mitochondrial;
  ENSP ID: ENSP00000469139
IWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQYQEQIMAFLIEALESGLSVLLCGLENPLGLNHPFLGAPGALDMSSALETPSCDPLRLLGALYGIRAHEWMFPV

SEQ ID NO: 9488 - protein, 352 aa, Homo sapiens; identical to SEQ ID NO: 9485
  Payload ID: 1938;
  Gene Symbol: BCAT2;
  Gene Name: branched chain amino-acid transaminase 2, mitochondrial;
  ENSP ID: ENSP00000469651

SEQ ID NO: 9489 - protein, 405 aa, Homo sapiens
  Payload ID: 1938;
  Gene Symbol: BCAT2;
  Gene Name: branched chain amino-acid transaminase 2, mitochondrial;
  ENSP ID: ENSP00000470216
MAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQVSCRELGNGLGACSLEKLVSHEPLD

SEQ ID NO: 9490 - protein, 313 aa, Homo sapiens
  Payload ID: 1938;
  Gene Symbol: BCAT2;
  Gene Name: branched chain amino-acid transaminase 2, mitochondrial;
  ENSP ID: ENSP00000470680
MAAAALGQLFEGMKAFKGKDQQVRLFRPWLNMDRMLRSAMRLCLPSFDKLELLECIRRLIEVDKDWVPDAAGTSLYVRPVLIGNEPSLGVSQPTRALLFVILCPVGAYFPGGSVTPVSLLADPAFIRAWVGGVGNYKLGGNYGPTVLVQQEALKRGCEQVLWLYGPDHQLTEVGTMNIFVYWTHEDGVLELVTPPLNGVILPGVVRQSLLDMAQTWGEFRVVERTITMKQLLRALEEGRVREVFGSGTACQVCPVHRILYKDRNLHIPTMENGPELILRFQKELKEIQVSCRELGNGLGACSLEKLVSHEPLD

SEQ ID NO: 9491 - protein, 108 aa, Homo sapiens
  Payload ID: 1938;
  Gene Symbol: BCAT2;
  Gene Name: branched chain amino-acid transaminase 2, mitochondrial;
  ENSP ID: ENSP00000472641
MTQKPHKKPGPGEPLVFGKTFTDHMLMVEWNDKGWGQPRIQPFQNLTLHPASSSLHYSLQLFEGMKAFKGKDQQVRLFRPWLNMDRMLRSAMRLCLPSFDKLELLECI

SEQ ID NO: 9492 - protein, 445 aa, Homo sapiens
  Payload ID: 1939;
  Gene Symbol: BCKDHA;
  Gene Name: branched chain keto acid dehydrogenase E1, alpha polypeptide;
  Uniprot ID:  P12694;
  ENSP ID: ENSP00000269980
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 9493 - protein, 448 aa, Homo sapiens
  Payload ID: 1939;
  Gene Symbol: BCKDHA;
  Gene Name: branched chain keto acid dehydrogenase E1, alpha polypeptide;
  Uniprot ID:  P12694;
  ENSP ID: ENSP00000416000
MAVAIAAARVWRLNRGLSQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYSSSPILPPDPHSREPTLTWGPLPLCRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 9494 - protein, 328 aa, Homo sapiens
  Payload ID: 1939;
  Gene Symbol: BCKDHA;
  Gene Name: branched chain keto acid dehydrogenase E1, alpha polypeptide;
  ENSP ID: ENSP00000440345
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQ

SEQ ID NO: 9495 - protein, 94 aa, Homo sapiens
  Payload ID: 1939;
  Gene Symbol: BCKDHA;
  Gene Name: branched chain keto acid dehydrogenase E1, alpha polypeptide;
  ENSP ID: ENSP00000445727
  MOD_RES (1)..(1): Any amino acid
XSQGWWDEEQEKAWRKQSRRKTCIRRCPPSSASSRSLWPATCRPTGSTTHWITSISETCSAHPHPSSATPRGSPTLRGAGGPDSTPLSSPVSSL

SEQ ID NO: 9496 - protein, 211 aa, Homo sapiens
  Payload ID: 1939;
  Gene Symbol: BCKDHA;
  Gene Name: branched chain keto acid dehydrogenase E1, alpha polypeptide;
  ENSP ID: ENSP00000445809
  MOD_RES (1)..(1): Any amino acid
XEFIQPNVISGIPIYRVMDRQGQIINPSEDPHLPKEKVLKLYKSMTLLNTMDRILYESQRQGRISFYMTNYGEEGTHVGSAAALDNTDLVFGQYREAEARPHHVAQAGLQLLGSSDPPTSASQSAGITGVLMYRDYPLELFMAQCYGNISDLGKGRQMPVHYGCKERHFVTISSPLATQIPQAVGAAYAAKRANANRVVICYFGEGAASEG

SEQ ID NO: 9497 - protein, 403 aa, Homo sapiens
  Payload ID: 1939;
  Gene Symbol: BCKDHA;
  Gene Name: branched chain keto acid dehydrogenase E1, alpha polypeptide;
  ENSP ID: ENSP00000471150
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYTATGGPKARASVGPSSPSTTGTCGIMMPLHAMGLWHPVSHQQELSAAPKPKGTTKPILESYLKSHLLGHSRYQLYIHQDAVRREKPQSNLNRESLI

SEQ ID NO: 9498 - protein, 392 aa, Homo sapiens
  Payload ID: 1940;
  Gene Symbol: BCKDHB;
  Gene Name: branched chain keto acid dehydrogenase E1, beta polypeptide;
  Uniprot ID:  P21953;
  ENSP ID: ENSP00000318351
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 9499 - protein, 392 aa, Homo sapiens; identical to SEQ ID NO: 9498
  Payload ID: 1940;
  Gene Symbol: BCKDHB;
  Gene Name: branched chain keto acid dehydrogenase E1, beta polypeptide;
  Uniprot ID:  P21953;
  ENSP ID: ENSP00000348880

SEQ ID NO: 9500 - protein, 218 aa, Homo sapiens
  Payload ID: 1940;
  Gene Symbol: BCKDHB;
  Gene Name: branched chain keto acid dehydrogenase E1, beta polypeptide;
  Uniprot ID:  P21953;
  ENSP ID: ENSP00000358775
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKIKVISLS

SEQ ID NO: 9501 - protein, 412 aa, Homo sapiens
  Payload ID: 1941;
  Gene Symbol: BCKDK;
  Gene Name: branched chain ketoacid dehydrogenase kinase;
  Uniprot ID:  O14874;
  ENSP ID: ENSP00000219794
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIIRISDRGGGIAHKDLDRVMDYHFTTAEASTQDPRISPLFGHLDMHSGAQSGPMHGFGFGLPTSRAYAEYLGGSLQLQSLQGIGTDVYLRLRHIDGREESFRI

SEQ ID NO: 9502 - protein, 335 aa, Homo sapiens
  Payload ID: 1941;
  Gene Symbol: BCKDK;
  Gene Name: branched chain ketoacid dehydrogenase kinase;
  Uniprot ID:  O14874;
  ENSP ID: ENSP00000287507
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRISDRGGGIAHKDLDRVMDYHFTTAEASTQDPRISPLFGHLDMHSGAQSGPMHG

SEQ ID NO: 9503 - protein, 365 aa, Homo sapiens
  Payload ID: 1941;
  Gene Symbol: BCKDK;
  Gene Name: branched chain ketoacid dehydrogenase kinase;
  Uniprot ID:  O14874;
  ENSP ID: ENSP00000378404
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIIRISDRGGGIAHKDLDRVMDYHFTTAEASTQDPRISPLFGHLDMHSGAQSGPMHG

SEQ ID NO: 9504 - protein, 412 aa, Homo sapiens; identical to SEQ ID NO: 9501
  Payload ID: 1941;
  Gene Symbol: BCKDK;
  Gene Name: branched chain ketoacid dehydrogenase kinase;
  Uniprot ID:  O14874;
  ENSP ID: ENSP00000378405

SEQ ID NO: 9505 - protein, 88 aa, Homo sapiens
  Payload ID: 1941;
  Gene Symbol: BCKDK;
  Gene Name: branched chain ketoacid dehydrogenase kinase;
  ENSP ID: ENSP00000454947
MILASVLRSGPGGGLPLRPLLGPALALRARSTSATDTHHVEMARERSKTVTSFYNQSAIDAAAEKPSVRLTPTMMLYAGRSQDGSHLL

SEQ ID NO: 9506 - protein, 60 aa, Homo sapiens
  Payload ID: 1941;
  Gene Symbol: BCKDK;
  Gene Name: branched chain ketoacid dehydrogenase kinase;
  ENSP ID: ENSP00000455866
MILASVLRSGPGGGLPLRPLLGPALALRARSTSATDTHHVEMARERSKTVTSFYNQSAID

SEQ ID NO: 9507 - protein, 217 aa, Homo sapiens
  Payload ID: 1941;
  Gene Symbol: BCKDK;
  Gene Name: branched chain ketoacid dehydrogenase kinase;
  ENSP ID: ENSP00000456479
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKTPV

SEQ ID NO: 9508 - protein, 216 aa, Homo sapiens
  Payload ID: 1941;
  Gene Symbol: BCKDK;
  Gene Name: branched chain ketoacid dehydrogenase kinase;
  ENSP ID: ENSP00000457226
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVKLTDFPPIKDQADEAQYCQLVRQLLDDHKDVVTLLAEGLRESRKHIEDEKLVRYFLDKTLTSRLGIRMLATHHLALHEDKPDFVGIICTRL

SEQ ID NO: 9509 - protein, 146 aa, Homo sapiens
  Payload ID: 1941;
  Gene Symbol: BCKDK;
  Gene Name: branched chain ketoacid dehydrogenase kinase;
  ENSP ID: ENSP00000457821
  MOD_RES (1)..(1): Any amino acid
XDVDLIIRISDRGGGIAHKDLDRVMDYHFTTAEASTQDPRISPLFGHLDMHSGAQSGPMHGALARTSTCGSATSMAGRKASGSDPTAFGLLTRPAWAAFPAGPPGSGRAAPCSTHCCILGLRDPDRWTYMELGTALPQQGPLPPRL

SEQ ID NO: 9510 - protein, 562 aa, Homo sapiens
  Payload ID: 1942;
  Gene Symbol: BRAP;
  Gene Name: BRCA1 associated prt;
  ENSP ID: ENSP00000330813
MSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 9511 - protein, 592 aa, Homo sapiens
  Payload ID: 1942;
  Gene Symbol: BRAP;
  Gene Name: BRCA1 associated prt;
  Uniprot ID:  Q7Z569;
  ENSP ID: ENSP00000403524
MSVSLVVIRLELAEHSPVPAGFGFSAAAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 9512 - protein, 711 aa, Homo sapiens
  Payload ID: 1943;
  Gene Symbol: BAP1;
  Gene Name: BRCA1 associated prt-1 (ubiquitin carboxy-terminal hydrolase);
  ENSP ID: ENSP00000296288
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 9513 - protein, 729 aa, Homo sapiens
  Payload ID: 1943;
  Gene Symbol: BAP1;
  Gene Name: BRCA1 associated prt-1 (ubiquitin carboxy-terminal hydrolase);
  Uniprot ID:  Q92560;
  ENSP ID: ENSP00000417132
MNKGWLELESDPGLFTLLVEDFGVKGVQVEEIYDLQSKCQGPVYGFIFLFKWIEERRSRRKVSTLVDDTSVIDDDIVNNMFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPIDHGPWGEDEEWTDKARRVIMERIGLATAGEPYHDIRFNLMAVVPDRRIKYEARLHVLKVNRQTVLEALQQLIRVTQPELIQTHKSQESQLPEESKSASNKSPLVLEANRAPAASEGNHTDGAEEAAGSCAQAPSHSPPNKPKLVVKPPGSSLNGVHPNPTPIVQRLPAFLDNHNYAKSPMQEEEDLAAGVGRSRVPVRPPQQYSDDEDDYEDDEEDDVQNTNSALRYKGKGTGKPGALSGSADGQLSVLQPNTINVLAEKLKESQKDLSIPLSIKTSSGAGSPAVAVPTHSQPSPTPSNESTDTASEIGSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 9514 - protein, 112 aa, Homo sapiens
  Payload ID: 1943;
  Gene Symbol: BAP1;
  Gene Name: BRCA1 associated prt-1 (ubiquitin carboxy-terminal hydrolase);
  ENSP ID: ENSP00000417776
MFFAHQLIPNSCATHALLSVLLNCSSVDLGPTLSRMKDFTKGFSPESKGYAIGNAPELAKAHNSHARPEPRHLPEKQNGLSAVRTMEAFHFVSYVPITGRLFELDGLKVYPI

SEQ ID NO: 9515 - protein, 129 aa, Homo sapiens
  Payload ID: 1943;
  Gene Symbol: BAP1;
  Gene Name: BRCA1 associated prt-1 (ubiquitin carboxy-terminal hydrolase);
  ENSP ID: ENSP00000418320
  MOD_RES (1)..(1): Any amino acid
XQNTNSALRYKGKGTGKPGALSGSADGQLSVLQPNTINVLAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 9516 - protein, 41 aa, Homo sapiens
  Payload ID: 1943;
  Gene Symbol: BAP1;
  Gene Name: BRCA1 associated prt-1 (ubiquitin carboxy-terminal hydrolase);
  ENSP ID: ENSP00000419709
MNKGWLELESDPGLFTLLVEDFGVKGVQVEEIYDLQSKCQG

SEQ ID NO: 9517 - protein, 253 aa, Homo sapiens
  Payload ID: 1943;
  Gene Symbol: BAP1;
  Gene Name: BRCA1 associated prt-1 (ubiquitin carboxy-terminal hydrolase);
  ENSP ID: ENSP00000420647
GSAFNSPLRSPIRSANPTRPSSPVTSHISKVLFGEDDSLLRVDCIRYNRAVRDLGPVISTGLLHLAEDGVLSPLALTEGGKGSSPSIRPIQGSQGSSSPVEKEVVEATDSREKTGMVRPGEPLSGEKYSPKLPIARGALLLARPDQRCNAGFWQELLALLKCVEAEIANYEACLKEEVEKRKKFKIDDQRRTHNYDEFICTFISMLAQEGMLANLVEQNISVRRRQGVSIGRLHKQRKPDRRKRSRPYKAKRQ

SEQ ID NO: 9518 - protein, 162 aa, Homo sapiens
  Payload ID: 1943;
  Gene Symbol: BAP1;
  Gene Name: BRCA1 associated prt-1 (ubiquitin carboxy-terminal hydrolase);
  ENSP ID: ENSP00000482839
MGGTRPHSFHRALRPDTADQPHSAQEAASGVGAQRGTAASSTAGCGAAGPGPSAWAAEYIFYLSETSIFLGSNPTCHHVDISSYLTMLSLLGAVLVGPGPCIMPRSQLQGPSWGPGWALGSGPCCSSPSHQPVPVVRKPGLLSSFLLGECQTQGPSTGLGWE

SEQ ID NO: 9519 - protein, 777 aa, Homo sapiens
  Payload ID: 1944;
  Gene Symbol: BARD1;
  Gene Name: BRCA1 associated RING domain 1;
  Uniprot ID:  Q99728;
  ENSP ID: ENSP00000260947
MPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 9520 - protein, 216 aa, Homo sapiens
  Payload ID: 1944;
  Gene Symbol: BARD1;
  Gene Name: BRCA1 associated RING domain 1;
  ENSP ID: ENSP00000392245
MPDNRQPRNRQPRIRSGNEPRSAPAMEPDGRGAWAHSRAALDRLEKLLRCSRCTNILREPVCLGGCEHIFCSNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQL

SEQ ID NO: 9521 - protein, 44 aa, Homo sapiens
  Payload ID: 1944;
  Gene Symbol: BARD1;
  Gene Name: BRCA1 associated RING domain 1;
  ENSP ID: ENSP00000405020
  MOD_RES (1)..(1): Any amino acid
XVKACLRRKVCEQEEKYEIPEGPRRSRLNREQLHLILKDDHDEQ

SEQ ID NO: 9522 - protein, 76 aa, Homo sapiens
  Payload ID: 1944;
  Gene Symbol: BARD1;
  Gene Name: BRCA1 associated RING domain 1;
  ENSP ID: ENSP00000412186
MPDNRQPRNRQPRIRSGNEPRSAPAMEPDGRGAWAHSRAALDRLEKLLRCSRCTNILREPVCLGGCEHIFCRFERR

SEQ ID NO: 9523 - protein, 758 aa, Homo sapiens
  Payload ID: 1944;
  Gene Symbol: BARD1;
  Gene Name: BRCA1 associated RING domain 1;
  Uniprot ID:  Q99728;
  ENSP ID: ENSP00000480470
MPDNRQPRNRQPRIRSGNEPRSAPAMEPDGRGAWAHSRAALDRLEKLLRCSRCNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 9524 - protein, 127 aa, Homo sapiens
  Payload ID: 1944;
  Gene Symbol: BARD1;
  Gene Name: BRCA1 associated RING domain 1;
  Uniprot ID:  Q99728;
  ENSP ID: ENSP00000481988
MPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSGRHTFC

SEQ ID NO: 9525 - protein, 264 aa, Homo sapiens
  Payload ID: 1944;
  Gene Symbol: BARD1;
  Gene Name: BRCA1 associated RING domain 1;
  ENSP ID: ENSP00000482293
MPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSGVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 9526 - protein, 167 aa, Homo sapiens
  Payload ID: 1944;
  Gene Symbol: BARD1;
  Gene Name: BRCA1 associated RING domain 1;
  ENSP ID: ENSP00000483275
MVAVPGPTVAPRSTAWRSCCAARVGVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 9527 - protein, 307 aa, Homo sapiens
  Payload ID: 1944;
  Gene Symbol: BARD1;
  Gene Name: BRCA1 associated RING domain 1;
  ENSP ID: ENSP00000484464
MPDNRQPRNRQPRIRSGNEPRSAPAMEPDGRGAWAHSRAALDRLEKLLRCSRCNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 9528 - protein, 326 aa, Homo sapiens
  Payload ID: 1944;
  Gene Symbol: BARD1;
  Gene Name: BRCA1 associated RING domain 1;
  ENSP ID: ENSP00000484976
MPDNRQPRNRQPRIRSGNEPRSAPAMEPDGRGAWAHSRAALDRLEKLLRCSRCTNILREPVCLGGCEHIFCSNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 9529 - protein, 1249 aa, Homo sapiens
  Payload ID: 1945;
  Gene Symbol: BRIP1;
  Gene Name: BRCA1 interacting prt C-terminal helicase 1;
  Uniprot ID:  Q9BX63;
  ENSP ID: ENSP00000259008
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPPSERNGTSSTCQDSPEKTTLAAKLSAKKQASIYRDENDDFQVEKKRIRPLETTQQIRKRHCFGTEVHNLDAKVDSGKTVKLNSPLEKINSFSPQKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTSPYLLEAASHLSPENFVEDEAKICVQELQCPKIITKNSPLPSSIISRKEKNDPVFLEEAGKAEKIVISRSTSPTFNKQTKRVSWSSFNSLGQYFTGKIPKATPELGSSENSASSPPRFKTEKMESKTVLPFTDKCESSNLTVNTSFGSCPQSETIISSLKIDATLTRKNHSEHPLCSEEALDPDIELSLVSEEDKQSTSNRDFETEAEDESIYFTPELYDPEDTDEEKNDLAETDRGNRLANNSDCILAKDLFEIRTIKEVDSAREVKAEDCIDTKLNGILHIEESKIDDIDGNVKTTWINELELGKTHEIEIKNFKPSPSKNKGMFPGFK

SEQ ID NO: 9530 - protein, 69 aa, Homo sapiens
  Payload ID: 1945;
  Gene Symbol: BRIP1;
  Gene Name: BRCA1 interacting prt C-terminal helicase 1;
  ENSP ID: ENSP00000462274
MSSMWSEYTIGGVKIYFPYKAYPSQLAMMNSILRGLNSKQHCLLESPTGSGKSLALLCSALAWQQSLSG

SEQ ID NO: 9531 - protein, 180 aa, Homo sapiens
  Payload ID: 1945;
  Gene Symbol: BRIP1;
  Gene Name: BRCA1 interacting prt C-terminal helicase 1;
  ENSP ID: ENSP00000463272
  MOD_RES (1)..(1): Any amino acid
XDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQLTSATAEGTNGYAQSWVSYSKMADAALTTATDETVDIYPRNLLSPSTALVLHSTEVECY

SEQ ID NO: 9532 - protein, 84 aa, Homo sapiens
  Payload ID: 1945;
  Gene Symbol: BRIP1;
  Gene Name: BRCA1 interacting prt C-terminal helicase 1;
  ENSP ID: ENSP00000463827
  MOD_RES (1)..(1): Any amino acid
XIWSGNEMLLTLHKMGITTATFPILQGHFSAVLQKEEKISPIYGKEEAREVPVISASTQIMLKGLFMVLDYLFRQNSRDEISLC

SEQ ID NO: 9533 - protein, 994 aa, Homo sapiens
  Payload ID: 1945;
  Gene Symbol: BRIP1;
  Gene Name: BRCA1 interacting prt C-terminal helicase 1;
  ENSP ID: ENSP00000464654
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPPSERNGTSSTCQDSPEKTTLAAKLSAKKQASIYRDENDDFQVEKKRIRPLETTQQIRKRHCFGTEVHNLDAKVDSGKTVKLNSPLEKINSFSPQKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTSPYLLEAASHLSPENFVEDEAKICVQELQCPKIITKNSPLPSSIISRKEKSMKSSSHLPLIEKSFIIFSEMIFIWV

SEQ ID NO: 9534 - protein, 291 aa, Homo sapiens
  Payload ID: 1946;
  Gene Symbol: BRCC3;
  Gene Name: BRCA1/BRCA2-containing complex, subunit 3;
  Uniprot ID:  P46736;
  ENSP ID: ENSP00000328641
MAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSEYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 9535 - protein, 292 aa, Homo sapiens
  Payload ID: 1946;
  Gene Symbol: BRCC3;
  Gene Name: BRCA1/BRCA2-containing complex, subunit 3;
  Uniprot ID:  P46736;
  ENSP ID: ENSP00000344103
MAVQVVQAVQAVHLESDAFLVCLNHALSTEKEEVMGLCIGELNDDTSRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSEYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 9536 - protein, 247 aa, Homo sapiens
  Payload ID: 1946;
  Gene Symbol: BRCC3;
  Gene Name: BRCA1/BRCA2-containing complex, subunit 3;
  Uniprot ID:  P46736;
  ENSP ID: ENSP00000358471
MAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSDLTHLDSVTKIHNGSVFTKNLCSQMSAVSGPLLQWLEDRLEQNQQHLQELQQEKEELMQELSSLE

SEQ ID NO: 9537 - protein, 316 aa, Homo sapiens
  Payload ID: 1946;
  Gene Symbol: BRCC3;
  Gene Name: BRCA1/BRCA2-containing complex, subunit 3;
  Uniprot ID:  P46736;
  ENSP ID: ENSP00000358474
MAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSESLHGPRDFWSSSQHISIEGQKEEERYERIEIPIHIVPHVTIGKVCLESAVELPKILCQEEQDAYRRIHSLTHLDSVTKIHNGSVFTKNLCSQMSAVSGPLLQWLEDRLEQNQQHLQELQQEKEELMQELSSLE

SEQ ID NO: 9538 - protein, 90 aa, Homo sapiens
  Payload ID: 1946;
  Gene Symbol: BRCC3;
  Gene Name: BRCA1/BRCA2-containing complex, subunit 3;
  ENSP ID: ENSP00000381988
MRTVAEKVDAVRIVHIHSVIILRRSDKRKDRVEISPEQLSAASTEAERLAELTGRPMRVVGWYHSHPHITVWPSHVGKYHGVAMFIVFRN

SEQ ID NO: 9539 - protein, 317 aa, Homo sapiens [sequence omitted]

SEQ ID NO: 9540 - protein, 226 aa, Homo sapiens
  Payload ID: 1946;
  Gene Symbol: BRCC3;
  Gene Name: BRCA1/BRCA2-containing complex, subunit 3;
  ENSP ID: ENSP00000413170
MAVQVVQAVQAVHLESDAFLVCLNHALSTEKEEVMGLCIGEVDAVRIVHIHSVIILRRSDKRKDRVEISPEQLSAASTEAERLAELTGRPMRVVGWYHSHPHITVWPSHVDVRTQAMYQMMDQGFVGLIFSCFIEDKNTKTGRVLYTCFQSIQAQKSSESLHGPRDFWSSSQHISIEGQKEEERYERIEIPIHIVPHVTIGKVCLESAVELPKILCQEEQDAYRRI

SEQ ID NO: 9541 - protein, 85 aa, Homo sapiens
  Payload ID: 1946;
  Gene Symbol: BRCC3;
  Gene Name: BRCA1/BRCA2-containing complex, subunit 3;
  ENSP ID: ENSP00000415152
  MOD_RES (1)..(1): Any amino acid
XVQVVQAVQAVHLESDAFLVCLNHALSTEKEEVMGLCIGEVIGVTPNLHILELKCAQLLKRLMPSELFTFILSSSYDVLIRGRTE

SEQ ID NO: 9542 - protein, 293 aa, Homo sapiens [sequence omitted]

SEQ ID NO: 9543 - protein, 317 aa, Homo sapiens [sequence omitted]

SEQ ID NO: 9544 - protein, 821 aa, Homo sapiens
  Payload ID: 1947;
  Gene Symbol: BRAT1;
  Gene Name: BRCA1-associated ATM activator 1;
  Uniprot ID:  Q6PJG6;
  ENSP ID: ENSP00000339637
MDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 9545 - protein, 168 aa, Homo sapiens
  Payload ID: 1947;
  Gene Symbol: BRAT1;
  Gene Name: BRCA1-associated ATM activator 1;
  ENSP ID: ENSP00000409209
MDPECAQLLPALCAVLVDPRQPVADDTCLEKLLDWFKTVTEGESSVVLLQEHPCLVELLSHVLKVQDLSSGVLSFSLRLAGTFAAQENCFQYLQVRSTPSSPCRETPACLWPRRPVSSWCTSWLCPCEVEPRGSPACRGVTGPRVPRRSWITLKSPCAPRPPPRSLRP

SEQ ID NO: 9546 - protein, 314 aa, Homo sapiens
  Payload ID: 1948;
  Gene Symbol: BCCIP;
  Gene Name: BRCA2 and CDKN1A interacting prt;
  Uniprot ID:  Q9P287;
  ENSP ID: ENSP00000278100
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEKAILKFNYSVQEESDTCLGGKWSFDDVPMTPLRTVMLIPGDKMNEIMDKLKEYLSV

SEQ ID NO: 9547 - protein, 292 aa, Homo sapiens
  Payload ID: 1948;
  Gene Symbol: BCCIP;
  Gene Name: BRCA2 and CDKN1A interacting prt;
  Uniprot ID:  Q9P287;
  ENSP ID: ENSP00000299130
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGWSVPPVLE

SEQ ID NO: 9548 - protein, 322 aa, Homo sapiens
  Payload ID: 1948;
  Gene Symbol: BCCIP;
  Gene Name: BRCA2 and CDKN1A interacting prt;
  Uniprot ID:  Q9P287;
  ENSP ID: ENSP00000357748
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEFFYEEQGKPEVLGGPDTRRGLEPVPIQHNGGSRGQVTALVSLKAGLIQSRSTLSDFQGTFMTVGIALS

SEQ ID NO: 9549 - protein, 1271 aa, Homo sapiens
  Payload ID: 1949;
  Gene Symbol: BCR;
  Gene Name: breakpoint cluster region;
  Uniprot ID:  P11274;
  ENSP ID: ENSP00000303507
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKNDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 9550 - protein, 1227 aa, Homo sapiens
  Payload ID: 1949;
  Gene Symbol: BCR;
  Gene Name: breakpoint cluster region;
  Uniprot ID:  P11274;
  ENSP ID: ENSP00000352535
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKNDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNELDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 9551 - protein, 465 aa, Homo sapiens
  Payload ID: 1949;
  Gene Symbol: BCR;
  Gene Name: breakpoint cluster region;
  ENSP ID: ENSP00000381524
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGEHPGAAEEVFQKLLPDIRGAADADQLVCETPDCPQHSADHQ

SEQ ID NO: 9552 - protein, 257 aa, Homo sapiens
  Payload ID: 1949;
  Gene Symbol: BCR;
  Gene Name: breakpoint cluster region;
  ENSP ID: ENSP00000396531
ALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLNLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAV

SEQ ID NO: 9553 - protein, 721 aa, Homo sapiens
  Payload ID: 1950;
  Gene Symbol: BRCA1;
  Gene Name: breast cancer 1, early onset;
  Uniprot ID:  P38398;
  ENSP ID: ENSP00000312236
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 9554 - protein, 1399 aa, Homo sapiens
  Payload ID: 1950;
  Gene Symbol: BRCA1;
  Gene Name: breast cancer 1, early onset;
  ENSP ID: ENSP00000326002
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGIGTRFLCLPQSIYRSELNVYAFGEHILQISKYS

SEQ ID NO: 9555 - protein, 1863 aa, Homo sapiens
  Payload ID: 1950;
  Gene Symbol: BRCA1;
  Gene Name: breast cancer 1, early onset;
  Uniprot ID:  P38398;
  ENSP ID: ENSP00000350283
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 9556 - protein, 437 aa, Homo sapiens
  Payload ID: 1950;
  Gene Symbol: BRCA1;
  Gene Name: breast cancer 1, early onset;
  ENSP ID: ENSP00000397145
  MOD_RES (1)..(1): Any amino acid
XLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKK

SEQ ID NO: 9557 - protein, 699 aa, Homo sapiens
  Payload ID: 1950;
  Gene Symbol: BRCA1;
  Gene Name: breast cancer 1, early onset;
  Uniprot ID:  P38398;
  ENSP ID: ENSP00000417148
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTGCPPNCGCAARCLDRGQWLPCNWADV

SEQ ID NO: 9558 - protein, 242 aa, Homo sapiens
  Payload ID: 1950;
  Gene Symbol: BRCA1;
  Gene Name: breast cancer 1, early onset;
  ENSP ID: ENSP00000417241
  MOD_RES (1)..(1): Any amino acid
XIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFE

SEQ ID NO: 9559 - protein, 222 aa, Homo sapiens
  Payload ID: 1950;
  Gene Symbol: BRCA1;
  Gene Name: breast cancer 1, early onset;
  ENSP ID: ENSP00000417554
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELGSDSSEDTVNKATYCSVGDQELLQITPQGTRDEISLDSAKK

SEQ ID NO: 9560 - protein, 63 aa, Homo sapiens
  Payload ID: 1950;
  Gene Symbol: BRCA1;
  Gene Name: breast cancer 1, early onset;
  Uniprot ID:  P38398;
  ENSP ID: ENSP00000417988
MDLSALRVEEVQNVINAMQKILECPICLELIKEPVSTKCDHIFCKFCMLKLLNQKKGPSQCPL

SEQ ID NO: 9561 - protein, 266 aa, Homo sapiens
  Payload ID: 1950;
  Gene Symbol: BRCA1;
  Gene Name: breast cancer 1, early onset;
  ENSP ID: ENSP00000418212
ELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVE

SEQ ID NO: 9562 - protein, 63 aa, Homo sapiens; identical to SEQ ID NO: 9560
  Payload ID: 1950;
  Gene Symbol: BRCA1;
  Gene Name: breast cancer 1, early onset;
  Uniprot ID:  P38398;
  ENSP ID: ENSP00000418548

SEQ ID NO: 9563 - protein, 1816 aa, Homo sapiens
  Payload ID: 1950;
  Gene Symbol: BRCA1;
  Gene Name: breast cancer 1, early onset;
  Uniprot ID:  P38398;
  ENSP ID: ENSP00000418775
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 9564 - protein, 572 aa, Homo sapiens
  Payload ID: 1950;
  Gene Symbol: BRCA1;
  Gene Name: breast cancer 1, early onset;
  ENSP ID: ENSP00000418819
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQS

SEQ ID NO: 9565 - protein, 1884 aa, Homo sapiens
  Payload ID: 1950;
  Gene Symbol: BRCA1;
  Gene Name: breast cancer 1, early onset;
  Uniprot ID:  P38398;
  ENSP ID: ENSP00000418960
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDSHIHGQRNNSMFSKRPREHISVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 9566 - protein, 177 aa, Homo sapiens
  Payload ID: 1950;
  Gene Symbol: BRCA1;
  Gene Name: breast cancer 1, early onset;
  ENSP ID: ENSP00000418986
MNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPN

SEQ ID NO: 9567 - protein, 473 aa, Homo sapiens
  Payload ID: 1950;
  Gene Symbol: BRCA1;
  Gene Name: breast cancer 1, early onset;
  ENSP ID: ENSP00000419103
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPN

SEQ ID NO: 9568 - protein, 649 aa, Homo sapiens
  Payload ID: 1950;
  Gene Symbol: BRCA1;
  Gene Name: breast cancer 1, early onset;
  ENSP ID: ENSP00000419274
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEE

SEQ ID NO: 9569 - protein, 498 aa, Homo sapiens
  Payload ID: 1950;
  Gene Symbol: BRCA1;
  Gene Name: breast cancer 1, early onset;
  ENSP ID: ENSP00000419481
ELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERK

SEQ ID NO: 9570 - protein, 622 aa, Homo sapiens
  Payload ID: 1950;
  Gene Symbol: BRCA1;
  Gene Name: breast cancer 1, early onset;
  ENSP ID: ENSP00000419988
MDLSALRVEEVQNVINAMQKILECPICLELIKEPVSTKCDHIFCKSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSE

SEQ ID NO: 9571 - protein, 319 aa, Homo sapiens
  Payload ID: 1950;
  Gene Symbol: BRCA1;
  Gene Name: breast cancer 1, early onset;
  ENSP ID: ENSP00000420201
  MOD_RES (1)..(1): Any amino acid
XQLDTGLEYANSYNFAKKENNSPEHLKDEVSIIQSMGYRNRAKRLLQSEPENPSLETSLSVQLSNLGTVRTLRTKQRIQPQKTSVYIELAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVE

SEQ ID NO: 9572 - protein, 59 aa, Homo sapiens
  Payload ID: 1950;
  Gene Symbol: BRCA1;
  Gene Name: breast cancer 1, early onset;
  ENSP ID: ENSP00000420253
MDLSALRVEEVQNVINAMQKILECPICLELIKEPVSTKCDHIFCKVLLCCPSWSTVVRS

SEQ ID NO: 9573 - protein, 623 aa, Homo sapiens
  Payload ID: 1950;
  Gene Symbol: BRCA1;
  Gene Name: breast cancer 1, early onset;
  ENSP ID: ENSP00000420412
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERK

SEQ ID NO: 9574 - protein, 759 aa, Homo sapiens
  Payload ID: 1950;
  Gene Symbol: BRCA1;
  Gene Name: breast cancer 1, early onset;
  Uniprot ID:  P38398;
  ENSP ID: ENSP00000420705
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 9575 - protein, 98 aa, Homo sapiens
  Payload ID: 1950;
  Gene Symbol: BRCA1;
  Gene Name: breast cancer 1, early onset;
  ENSP ID: ENSP00000420781
MDLSALRVEEVQNVINAMQKILECPICLELIKEPVSTKCDHIFCKSLQESTRFSQLVEELLKIICAFQLDTGLEYANSYNFAKKENNSPEHLKDEVSI

SEQ ID NO: 9576 - protein, 96 aa, Homo sapiens
  Payload ID: 1950;
  Gene Symbol: BRCA1;
  Gene Name: breast cancer 1, early onset;
  ENSP ID: ENSP00000465347
MSDSKKTWLQYQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 9577 - protein, 173 aa, Homo sapiens
  Payload ID: 1950;
  Gene Symbol: BRCA1;
  Gene Name: breast cancer 1, early onset;
  ENSP ID: ENSP00000465818
MDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 9578 - protein, 354 aa, Homo sapiens
  Payload ID: 1950;
  Gene Symbol: BRCA1;
  Gene Name: breast cancer 1, early onset;
  ENSP ID: ENSP00000467329
MHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 9579 - protein, 23 aa, Homo sapiens
  Payload ID: 1950;
  Gene Symbol: BRCA1;
  Gene Name: breast cancer 1, early onset;
  ENSP ID: ENSP00000478114
MDLSALRVEEVQNVINAMQKILE

SEQ ID NO: 9580 - protein, 798 aa, Homo sapiens
  Payload ID: 1950;
  Gene Symbol: BRCA1;
  Gene Name: breast cancer 1, early onset;
  ENSP ID: ENSP00000489431
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNH

SEQ ID NO: 9581 - protein, 3418 aa, Homo sapiens [sequence omitted]

SEQ ID NO: 9582 - protein, 64 aa, Homo sapiens
  Payload ID: 1951;
  Gene Symbol: BRCA2;
  Gene Name: breast cancer 2, early onset;
  ENSP ID: ENSP00000433168
SSGLYIFRNEREEEKEAAKYVEAQQKRLEALFTKIQEEFEEHEVTSSTEVLNPPKSSMRVGINF

SEQ ID NO: 9583 - protein, 186 aa, Homo sapiens
  Payload ID: 1951;
  Gene Symbol: BRCA2;
  Gene Name: breast cancer 2, early onset;
  ENSP ID: ENSP00000434898
  MOD_RES (1)..(1): Any amino acid
XSKSKSERANIQLAATKKTQYQQLPVSDEILFQIYQPREPLHFSKFLDPDFQPSCSEVDLIGFVVSVVKKTGLAPFVYLSDECYNLLAIKFWIDLNEDIIKPHMLIAASNLQWRPESKSGLLTLFAGDFSVFSASPKEGHFQETFNKMKNTVERQSLALSPPGWSTIAQSRITAVSASWAQAILVP

SEQ ID NO: 9584 - protein, 3418 aa, Homo sapiens [sequence omitted]

SEQ ID NO: 9585 - protein, 870 aa, Homo sapiens
  Payload ID: 1952;
  Gene Symbol: BCAR1;
  Gene Name: breast cancer anti-estrogen resistance 1;
  Uniprot ID:  P56945;
  ENSP ID: ENSP00000162330
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 9586 - protein, 888 aa, Homo sapiens
  Payload ID: 1952;
  Gene Symbol: BCAR1;
  Gene Name: breast cancer anti-estrogen resistance 1;
  Uniprot ID:  P56945;
  ENSP ID: ENSP00000377072
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVSKCQGNARARLRLWGVWVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 9587 - protein, 888 aa, Homo sapiens
  Payload ID: 1952;
  Gene Symbol: BCAR1;
  Gene Name: breast cancer anti-estrogen resistance 1;
  Uniprot ID:  P56945;
  ENSP ID: ENSP00000377074
MHCPGEAPLAAPRPTPKDPCLRNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 9588 - protein, 916 aa, Homo sapiens
  Payload ID: 1952;
  Gene Symbol: BCAR1;
  Gene Name: breast cancer anti-estrogen resistance 1;
  Uniprot ID:  P56945;
  ENSP ID: ENSP00000391669
MPAKPFLSSVLLSWKVLDFSGPGPQGTGQPCSCGHWAEGQGGPPEPAGGPNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 9589 - protein, 888 aa, Homo sapiens
  Payload ID: 1952;
  Gene Symbol: BCAR1;
  Gene Name: breast cancer anti-estrogen resistance 1;
  Uniprot ID:  P56945;
  ENSP ID: ENSP00000392708
MLTHRPQEAEQRGRTPGPSFEWNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 9590 - protein, 722 aa, Homo sapiens
  Payload ID: 1952;
  Gene Symbol: BCAR1;
  Gene Name: breast cancer anti-estrogen resistance 1;
  Uniprot ID:  P56945;
  ENSP ID: ENSP00000440370
MQGKNVLAKALYDNVAESPDELSFRKGDIMTVLEQDTQGLDGWWLCSLHGRQGIVPGNRLKILVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 9591 - protein, 868 aa, Homo sapiens
  Payload ID: 1952;
  Gene Symbol: BCAR1;
  Gene Name: breast cancer anti-estrogen resistance 1;
  Uniprot ID:  P56945;
  ENSP ID: ENSP00000440415
MENVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 9592 - protein, 57 aa, Homo sapiens
  Payload ID: 1952;
  Gene Symbol: BCAR1;
  Gene Name: breast cancer anti-estrogen resistance 1;
  ENSP ID: ENSP00000442161
MPAKPFLSSVLLSWKVLDFSGPGPQGTGQPCSCGHWAEGQGGPPEPAGGPVSQGSSD

SEQ ID NO: 9593 - protein, 870 aa, Homo sapiens
  Payload ID: 1952;
  Gene Symbol: BCAR1;
  Gene Name: breast cancer anti-estrogen resistance 1;
  Uniprot ID:  P56945;
  ENSP ID: ENSP00000443841
MSVPNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 9594 - protein, 238 aa, Homo sapiens
  Payload ID: 1952;
  Gene Symbol: BCAR1;
  Gene Name: breast cancer anti-estrogen resistance 1;
  ENSP ID: ENSP00000454702
  MOD_RES (1)..(1): Any amino acid
XPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVY

SEQ ID NO: 9595 - protein, 57 aa, Homo sapiens; identical to SEQ ID NO: 9592
  Payload ID: 1952;
  Gene Symbol: BCAR1;
  Gene Name: breast cancer anti-estrogen resistance 1;
  ENSP ID: ENSP00000455166

SEQ ID NO: 9596 - protein, 133 aa, Homo sapiens
  Payload ID: 1952;
  Gene Symbol: BCAR1;
  Gene Name: breast cancer anti-estrogen resistance 1;
  ENSP ID: ENSP00000455810
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPAT

SEQ ID NO: 9597 - protein, 135 aa, Homo sapiens
  Payload ID: 1952;
  Gene Symbol: BCAR1;
  Gene Name: breast cancer anti-estrogen resistance 1;
  ENSP ID: ENSP00000456625
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDL

SEQ ID NO: 9598 - protein, 128 aa, Homo sapiens
  Payload ID: 1952;
  Gene Symbol: BCAR1;
  Gene Name: breast cancer anti-estrogen resistance 1;
  ENSP ID: ENSP00000456929
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPF

SEQ ID NO: 9599 - protein, 58 aa, Homo sapiens
  Payload ID: 1952;
  Gene Symbol: BCAR1;
  Gene Name: breast cancer anti-estrogen resistance 1;
  ENSP ID: ENSP00000457097
MTVLEQDTQGLDGWWLCSLHGRQGIVPGNRLKILVGMYDKKPAGPGPGPPATPAQPQP

SEQ ID NO: 9600 - protein, 50 aa, Homo sapiens
  Payload ID: 1952;
  Gene Symbol: BCAR1;
  Gene Name: breast cancer anti-estrogen resistance 1;
  ENSP ID: ENSP00000457231
MTVLEQDTQGLDGWWLCSLHGRQGIVPGNRLKILVGMYDKKPAGPGPGPP

SEQ ID NO: 9601 - protein, 80 aa, Homo sapiens
  Payload ID: 1952;
  Gene Symbol: BCAR1;
  Gene Name: breast cancer anti-estrogen resistance 1;
  ENSP ID: ENSP00000457457
MTVLEQDTQGLDGWWLCSLHGRQGIVPGNRLKILVGMYDKKPAGPGPGPPATPAQPQPGLHAPAPPASQYTPMLPNTYQP

SEQ ID NO: 9602 - protein, 120 aa, Homo sapiens
  Payload ID: 1952;
  Gene Symbol: BCAR1;
  Gene Name: breast cancer anti-estrogen resistance 1;
  ENSP ID: ENSP00000458088
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFS

SEQ ID NO: 9603 - protein, 825 aa, Homo sapiens
  Payload ID: 1953;
  Gene Symbol: BCAR3;
  Gene Name: breast cancer anti-estrogen resistance 3;
  Uniprot ID:  O75815;
  ENSP ID: ENSP00000260502
MAAGKFASLPRNMPVNHQFPLASSMDLLSSRSPLAEHRPDAYQDVSIHGTLPRKKKGPPPIRSCDDFSHMGTLPHSKSPRQNSPVTQDGIQESPWQDRHGETFTFRDPHLLDPTVEYVKFSKERHIMDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 9604 - protein, 825 aa, Homo sapiens; identical to SEQ ID NO: 9603
  Payload ID: 1953;
  Gene Symbol: BCAR3;
  Gene Name: breast cancer anti-estrogen resistance 3;
  Uniprot ID:  O75815;
  ENSP ID: ENSP00000359263

SEQ ID NO: 9605 - protein, 825 aa, Homo sapiens; identical to SEQ ID NO: 9603
  Payload ID: 1953;
  Gene Symbol: BCAR3;
  Gene Name: breast cancer anti-estrogen resistance 3;
  Uniprot ID:  O75815;
  ENSP ID: ENSP00000359264

SEQ ID NO: 9606 - protein, 734 aa, Homo sapiens
  Payload ID: 1953;
  Gene Symbol: BCAR3;
  Gene Name: breast cancer anti-estrogen resistance 3;
  Uniprot ID:  O75815;
  ENSP ID: ENSP00000359267
MPKECSAFHALSAALCCFYHRKSFIGVKFSKERHIMDRTPEKLKKELEEELLLSSEDLRSHAWYHGRIPRQVSENLVQRDGDFLVRDSLSSPGNFVLTCQWKNLAQHFKINRTVLRLSEAYSRVQYQFEMESFDSIPGLVRCYVGNRRPISQQSGAIIFQPINRTVPLRCLEEHYGTSPGQAREGSLTKGRPDVAKRLSLTMGGVQAREQNLPRGNLLRNKEKSGSQPACLDHMQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 9607 - protein, 501 aa, Homo sapiens
  Payload ID: 1953;
  Gene Symbol: BCAR3;
  Gene Name: breast cancer anti-estrogen resistance 3;
  Uniprot ID:  O75815;
  ENSP ID: ENSP00000441343
MQDRRALSLKAHQSESYLPIGCKLPPQSSGVDTSPCPNSPVFRTGSEPALSPAVVRRVSSDARAGEALRGSDSQLCPKPPPKPCKVPFLKVPSSPSAWLNSEANYCELNPAFATGCGRGAKLPSCAQGSHTELLTAKQNEAPGPRNSGVNYLILDDDDRERPWEPAAAQMEKGQWDKGEFVTPLLETVSSFRPNEFESKFLPPENKPLETAMLKRAKELFTNNDPKVIAQHVLSMDCRVARILGVSEEMRRNMGVSSGLELITLPHGHQLRLDIIERHNTMAIGIAVDILGCTGTLEDRAATLSKIIQVAVELKDSMGDLYSFSALMKALEMPQITRLEKTWTALRHQYTQTAILYEKQLKPFSKLLHEGRESTCVPPNNVSVPLLMPLVTLMERQAVTFEGTDMWEKNDQSCEIMLNHLATARFMAEAADSYRMNAERILAGFQPDEEMNEICKTEFQMRLLWGSKGAQVNQTERYEKFNQILTALSRKLEPPPVKQAEL

SEQ ID NO: 9608 - protein, 246 aa, Homo sapiens
  Payload ID: 1954;
  Gene Symbol: BRMS1;
  Gene Name: breast cancer metastasis suppressor 1;
  Uniprot ID:  Q9HCU9;
  ENSP ID: ENSP00000353042
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSDGP

SEQ ID NO: 9609 - protein, 290 aa, Homo sapiens
  Payload ID: 1954;
  Gene Symbol: BRMS1;
  Gene Name: breast cancer metastasis suppressor 1;
  ENSP ID: ENSP00000396052
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSDDRRTHRPLRVCPARLLWCCWALPLHLALAWTPPLPSSRPAQLWPWS

SEQ ID NO: 9610 - protein, 267 aa, Homo sapiens
  Payload ID: 1954;
  Gene Symbol: BRMS1;
  Gene Name: breast cancer metastasis suppressor 1;
  ENSP ID: ENSP00000431510
  MOD_RES (1)..(1): Any amino acid
XTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKDLDPAVHSQGDPQSSWHCTQDSRLPPADRRTHRPLRVCPARLLWCCWALPLHLALAWTPPLPSSRPAQLWPWS

SEQ ID NO: 9611 - protein, 244 aa, Homo sapiens
  Payload ID: 1954;
  Gene Symbol: BRMS1;
  Gene Name: breast cancer metastasis suppressor 1;
  ENSP ID: ENSP00000433740
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQVAGIYKGFCLDVIRNKYECELQGAKQHLESEKLLLYDTLQGELQERIQRLEEDRQSLDLSSEWWDDKLHARGSSRSWDSLPPSKRKKAPLVSGPYIVYMLQEIDILEDWTAIKKARAAVSPQKRKSD

SEQ ID NO: 9612 - protein, 126 aa, Homo sapiens
  Payload ID: 1954;
  Gene Symbol: BRMS1;
  Gene Name: breast cancer metastasis suppressor 1;
  ENSP ID: ENSP00000434591
MPVQPPSKDTEEMEAEGDSAAEMNGEEEESEEERSGSQTESEEESSEMDDEDYERRRSECVSEMLDLEKQFSELKEKLFRERLSQLRLRLEEVGAERAPEYTEPLGGLQRSLKIRIQGSTRASVWM

SEQ ID NO: 9613 - protein, 323 aa, Homo sapiens
  Payload ID: 1955;
  Gene Symbol: BRMS1L;
  Gene Name: breast cancer metastasis-suppressor 1-like;
  Uniprot ID:  Q5PSV4;
  ENSP ID: ENSP00000216807
MPVHSRGDKKETNHHDEMEVDYAENEGSSSEDEDTESSSVSEDGDSSEMDDEDCERRRMECLDEMSNLEKQFTDLKDQLYKERLSQVDAKLQEVIAGKAPEYLEPLATLQENMQIRTKVAGIYRELCLESVKNKYECEIQASRQHCESEKLLLYDTVQSELEEKIRRLEEDRHSIDITSELWNDELQSRKKRKDPFSPDKKKPVVVSGPYIVYMLQDLDILEDWTTIRKAMATLGPHRVKTEPPVKLEKHLHSARSEEGRLYYDGEWYIRGQTICIDKKDECPTSAVITTINHDEVWFKRPDGSKSKLYISQLQKGKYSIKHS

SEQ ID NO: 9614 - protein, 215 aa, Homo sapiens
  Payload ID: 1955;
  Gene Symbol: BRMS1L;
  Gene Name: breast cancer metastasis-suppressor 1-like;
  ENSP ID: ENSP00000446826
  MOD_RES (1)..(1): Any amino acid
XVDAKLQEVIAGKAPEYLEPLATLQENMQIRTKVAGIYRELCLESVKNKYECEIQASRQHCESEKLLLYDTVQSELEEKIRRLEEDRHSIDITSELWNDELQSRKKRKDPFSPDKKKPVVVSGPYIVYMLQDLDILEDWTTIRKAMATLGPHRVKTEPPVKLEKHLHSARSEEGRLYYDGEWYIRGQTICIDKKDECPTRSYNAAYVYPIGVIMK

SEQ ID NO: 9615 - protein, 48 aa, Homo sapiens
  Payload ID: 1955;
  Gene Symbol: BRMS1L;
  Gene Name: breast cancer metastasis-suppressor 1-like;
  ENSP ID: ENSP00000447022
MPVHSRGDKKETNHHDEMEVDYAENEGSSSEDEDTESSSVSEDGDSSV

SEQ ID NO: 9616 - protein, 48 aa, Homo sapiens; identical to SEQ ID NO: 9615
  Payload ID: 1955;
  Gene Symbol: BRMS1L;
  Gene Name: breast cancer metastasis-suppressor 1-like;
  ENSP ID: ENSP00000448615

SEQ ID NO: 9617 - protein, 506 aa, Homo sapiens
  Payload ID: 1956;
  Gene Symbol: BCAS1;
  Gene Name: breast carcinoma amplified sequence 1;
  ENSP ID: ENSP00000360490
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 9618 - protein, 384 aa, Homo sapiens
  Payload ID: 1956;
  Gene Symbol: BCAS1;
  Gene Name: breast carcinoma amplified sequence 1;
  ENSP ID: ENSP00000360495
MSAPIKLQRTKTQVRAGHFRWQLDRGRTQIKPQGTPRPKTRSSLPPGIPRFSHLRQGEQEEKLPPSPRTPAFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 9619 - protein, 584 aa, Homo sapiens
  Payload ID: 1956;
  Gene Symbol: BCAS1;
  Gene Name: breast carcinoma amplified sequence 1;
  Uniprot ID:  O75363;
  ENSP ID: ENSP00000379290
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENVVCESPVEIIKSKEVESALQTVDLNEGDAAPEPTEAKLKREESKPRTSLMAFLRQMSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 9620 - protein, 476 aa, Homo sapiens
  Payload ID: 1956;
  Gene Symbol: BCAS1;
  Gene Name: breast carcinoma amplified sequence 1;
  ENSP ID: ENSP00000396361
TLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTASKAESVCDGQAGQKTSEIQARGTKKKHLDSPRLGLAFRKFFRHKGAEKSPTTSADLKSDKANFTSQETQGAGKNSKGCNPSGHTQSVTTPEPAKEGTKEKSGPTSLPLGKLFWKKVVCESPVEIIKSKEVESALQTVDLNEGDAAPEPTEAKLKREESKPRTSLMAFLRQMTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSKYTGKCVFSHVKKKWPFQEWSY

SEQ ID NO: 9621 - protein, 247 aa, Homo sapiens
  Payload ID: 1956;
  Gene Symbol: BCAS1;
  Gene Name: breast carcinoma amplified sequence 1;
  ENSP ID: ENSP00000399936
  MOD_RES (1)..(1): Any amino acid
XNNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 9622 - protein, 225 aa, Homo sapiens
  Payload ID: 1957;
  Gene Symbol: BCAS2;
  Gene Name: breast carcinoma amplified sequence 2;
  Uniprot ID:  O75934;
  ENSP ID: ENSP00000358554
MAGTGLVAGEVVVDALPYFDQGYEAPGVREAAAALVEEETRRYRPTKNYLSYLTAPDYSAFETDIMRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 9623 - protein, 928 aa, Homo sapiens
  Payload ID: 1958;
  Gene Symbol: BCAS3;
  Gene Name: breast carcinoma amplified sequence 3;
  Uniprot ID:  Q9H6U6;
  ENSP ID: ENSP00000375067
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGPYLFGAGCFSIKAPCKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 9624 - protein, 913 aa, Homo sapiens
  Payload ID: 1958;
  Gene Symbol: BCAS3;
  Gene Name: breast carcinoma amplified sequence 3;
  Uniprot ID:  Q9H6U6;
  ENSP ID: ENSP00000385323
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 9625 - protein, 935 aa, Homo sapiens
  Payload ID: 1958;
  Gene Symbol: BCAS3;
  Gene Name: breast carcinoma amplified sequence 3;
  Uniprot ID:  Q9H6U6;
  ENSP ID: ENSP00000386173
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTDTALDVAVKTFPPERHVAVKCFELQREGSIETLSNSSGSTSGSIPRNFDGYRSPLPTNESQPLSLFPTGFP

SEQ ID NO: 9626 - protein, 183 aa, Homo sapiens
  Payload ID: 1958;
  Gene Symbol: BCAS3;
  Gene Name: breast carcinoma amplified sequence 3;
  ENSP ID: ENSP00000464711
SSVLQSHGPSDTPQPLLDFDTDDLDLNSLRIQPVRSDPVSMPGSSRPVSDRRGVSTVIDAASVDSSTALEWGTSRPSHSRSAHHPSVQGARSSAHLKPQGLMETIHSHSRMSQHCMQPAMATGRRVRHGPWSCRLTCPRLSQDRAQDLTEEASQQGTFDRSVTLLEVCGSWPEGFGLRHMSSM

SEQ ID NO: 9627 - protein, 684 aa, Homo sapiens
  Payload ID: 1958;
  Gene Symbol: BCAS3;
  Gene Name: breast carcinoma amplified sequence 3;
  Uniprot ID:  Q9H6U6;
  ENSP ID: ENSP00000464825
MNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 9628 - protein, 36 aa, Homo sapiens
  Payload ID: 1958;
  Gene Symbol: BCAS3;
  Gene Name: breast carcinoma amplified sequence 3;
  ENSP ID: ENSP00000464864
MNEAMATDSPRRPSRCTGGVVVRPQAVTYIKKSGIS

SEQ ID NO: 9629 - protein, 178 aa, Homo sapiens
  Payload ID: 1958;
  Gene Symbol: BCAS3;
  Gene Name: breast carcinoma amplified sequence 3;
  ENSP ID: ENSP00000465175
MNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAK

SEQ ID NO: 9630 - protein, 135 aa, Homo sapiens
  Payload ID: 1958;
  Gene Symbol: BCAS3;
  Gene Name: breast carcinoma amplified sequence 3;
  ENSP ID: ENSP00000465328
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFG

SEQ ID NO: 9631 - protein, 53 aa, Homo sapiens
  Payload ID: 1958;
  Gene Symbol: BCAS3;
  Gene Name: breast carcinoma amplified sequence 3;
  ENSP ID: ENSP00000465441
MNEAMATDSPRRPSRCTGGVVVRPQAVTEQSYMESVVTFLQDVVPQKSNVAKE

SEQ ID NO: 9632 - protein, 145 aa, Homo sapiens
  Payload ID: 1958;
  Gene Symbol: BCAS3;
  Gene Name: breast carcinoma amplified sequence 3;
  ENSP ID: ENSP00000465539
MNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGH

SEQ ID NO: 9633 - protein, 56 aa, Homo sapiens
  Payload ID: 1958;
  Gene Symbol: BCAS3;
  Gene Name: breast carcinoma amplified sequence 3;
  ENSP ID: ENSP00000466075
MNEAMATDSPRRPSRCTGGVVVRPQAVTEQSYMESVVTFLQDVVPQASRKQLIGWV

SEQ ID NO: 9634 - protein, 928 aa, Homo sapiens
  Payload ID: 1958;
  Gene Symbol: BCAS3;
  Gene Name: breast carcinoma amplified sequence 3;
  Uniprot ID:  Q9H6U6;
  ENSP ID: ENSP00000466078
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTDTALDVAVKTFPPERHVAVKCFGKKKGKKKQCQQPSVREQPNSNKACVRDGGRTSARGKHRDSE

SEQ ID NO: 9635 - protein, 184 aa, Homo sapiens
  Payload ID: 1958;
  Gene Symbol: BCAS3;
  Gene Name: breast carcinoma amplified sequence 3;
  ENSP ID: ENSP00000466552
MNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICF

SEQ ID NO: 9636 - protein, 53 aa, Homo sapiens; identical to SEQ ID NO: 9631
  Payload ID: 1958;
  Gene Symbol: BCAS3;
  Gene Name: breast carcinoma amplified sequence 3;
  ENSP ID: ENSP00000467743

SEQ ID NO: 9637 - protein, 950 aa, Homo sapiens
  Payload ID: 1958;
  Gene Symbol: BCAS3;
  Gene Name: breast carcinoma amplified sequence 3;
  Uniprot ID:  Q9H6U6;
  ENSP ID: ENSP00000468592
MNEAMATDSPRRPSRCTGGVVVRPQAVTEQSYMESVVTFLQDVVPQAYSGTPLTEEKEKIVWVRFENADLNDTSRNLEFHEIHSTGNEPPLLIMIGYSDGMQVWSIPISGEAQELFSVRHGPIRAARILPAPQFGAQKCDNFAEKRPLLGVCKSIGSSGTSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGPYLFGAGCFSIKAPCKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTDTALDVAVKTFPPERHVAVKCFELQREGSIETLSNSSGSTSGSIPRNFDGYRSPLPTNESQPLSLFPTGFP

SEQ ID NO: 9638 - protein, 699 aa, Homo sapiens
  Payload ID: 1958;
  Gene Symbol: BCAS3;
  Gene Name: breast carcinoma amplified sequence 3;
  ENSP ID: ENSP00000468682
MNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGPYLFGAGCFSIKAPCKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASGTFDRSVTLLEVCGSWPEGFGLRHMSSMEHTEEGLRERLADAMAESPSRDVVGSGTELQREGSIETLSNSSGSTSGSIPRNFDGYRSPLPTNESQPLSLFPTGFP

SEQ ID NO: 9639 - protein, 650 aa, Homo sapiens
  Payload ID: 1958;
  Gene Symbol: BCAS3;
  Gene Name: breast carcinoma amplified sequence 3;
  ENSP ID: ENSP00000484605
TSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASG

SEQ ID NO: 9640 - protein, 665 aa, Homo sapiens
  Payload ID: 1958;
  Gene Symbol: BCAS3;
  Gene Name: breast carcinoma amplified sequence 3;
  ENSP ID: ENSP00000485015
TSPPYCCVDLYSLRTGEMVKSIQFKTPIYDLHCNKRILVVVLQEKIAAFDSCTFTKKFFVTSCYPCPGPNMNPIALGSRWLAYAENKLIRCHQSRGGACGDNIQSYTATVISAAKTLKSGLTMVGKVVTQLTGTLPSGVTEDDVAIHSNSRRSPLVPGIITVIDTETVGEGQVLVSEDSDSDGIVAHFPAHEKPVCCMAFNTSGMLLVTTDTLGHDFHVFQILTHPWSSSQCAVHHLYTLHRGETEAKVQDICFSHDCRWVVVSTLRGTSHVFPINPYGGQPCVRTHMSPRVVNRMSRFQKSAGLEEIEQELTSKQGGRCSPVPGLSSSPSGSPLHGKLNSQDSYNNFTNNNPGNPRLSPLPSLMVVMPLAQIKQPMTLGTITKRTGPYLFGAGCFSIKAPCKVKPPPQISPSKSMGGEFCVAAIFGTSRSWFANNAGLKREKDQSKQVVVESLYIISCYGTLVEHMMEPRPLSTAPKISDDTPLEMMTSPRASWTLVRTPQWNELQPPFNANHPLLLAADAVQYYQFLLAGLVPPGSPGPITRHGSYDSLASDHSGQEDEEWLSQVEIVTHTGPHRRLWMGPQFQFKTIHPSGQTTVISSSSSVLQSHGPSDTPQPLLDFDTDDLDLNSLRIQPVRSDPVSMPGSSRPVSDRRGVSTVIDAASG

SEQ ID NO: 9641 - protein, 53 aa, Homo sapiens; identical to SEQ ID NO: 9631
  Payload ID: 1958;
  Gene Symbol: BCAS3;
  Gene Name: breast carcinoma amplified sequence 3;
  ENSP ID: ENSP00000486318

SEQ ID NO: 9642 - protein, 211 aa, Homo sapiens
  Payload ID: 1959;
  Gene Symbol: BCAS4;
  Gene Name: breast carcinoma amplified sequence 4;
  Uniprot ID:  Q8TDM0;
  ENSP ID: ENSP00000351642
MQRTGGGAPRPGRNHGLPGSLRQPDPVALLMLLVDADQPEPMRSGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNVECSGTIPARCNLRLPGSSDSPASASQVAGITEVTCTGARDVRAAHTV

SEQ ID NO: 9643 - protein, 203 aa, Homo sapiens
  Payload ID: 1959;
  Gene Symbol: BCAS4;
  Gene Name: breast carcinoma amplified sequence 4;
  Uniprot ID:  Q8TDM0;
  ENSP ID: ENSP00000360669
MQRTGGGAPRPGRNHGLPGSLRQPDPVALLMLLVDADQPEPMRSGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNKSPAPVPVTYELPTLYRTEDYFPVDAGEAQHHPRTCPRPL

SEQ ID NO: 9644 - protein, 117 aa, Homo sapiens
  Payload ID: 1959;
  Gene Symbol: BCAS4;
  Gene Name: breast carcinoma amplified sequence 4;
  ENSP ID: ENSP00000392594
MLLVDADQPEPMRSGARELALFLTPEPGAEAKEVEETIEGMLLRLEEFCSLADLIRSDTSQILEENIPVLKAKLTEMRGIYAKVDRLEKSPAPVPVTYELPTLYRTEDYFPVDAGEA

SEQ ID NO: 9645 - protein, 89 aa, Homo sapiens
  Payload ID: 1959;
  Gene Symbol: BCAS4;
  Gene Name: breast carcinoma amplified sequence 4;
  ENSP ID: ENSP00000418559
MLLVDADQPEPMRSGARELALFLTPEPGAEAKEVEETIEGMLLRLEEFCSLADLIRSDTSQILEENIPVLKAKLTEMRGIYAKVDRLES

SEQ ID NO: 9646 - protein, 181 aa, Homo sapiens
  Payload ID: 1959;
  Gene Symbol: BCAS4;
  Gene Name: breast carcinoma amplified sequence 4;
  ENSP ID: ENSP00000477167
MLLVDADQPEPMRSGARELALFLTPEPGAEAKEVEETIEGMLLRLEEFCSLADLIRSDTSQILEENIPVLKAKLTEMRGIYAKVDRLEAFVKMVGHHVAFLEADVLQAERDHGAFPQALRRWLGSAGLPSFRNVECSGTIPARCNLRLPGSSDSPASASQVAGITEVTCTGARDVRAAHTV

SEQ ID NO: 9647 - protein, 911 aa, Homo sapiens
  Payload ID: 1960;
  Gene Symbol: BCAN;
  Gene Name: brevican;
  Uniprot ID:  Q96GW7;
  ENSP ID: ENSP00000331210
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 9648 - protein, 671 aa, Homo sapiens
  Payload ID: 1960;
  Gene Symbol: BCAN;
  Gene Name: brevican;
  Uniprot ID:  Q96GW7;
  ENSP ID: ENSP00000354925
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 9649 - protein, 213 aa, Homo sapiens
  Payload ID: 1960;
  Gene Symbol: BCAN;
  Gene Name: brevican;
  ENSP ID: ENSP00000389898
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTV

SEQ ID NO: 9650 - protein, 145 aa, Homo sapiens
  Payload ID: 1960;
  Gene Symbol: BCAN;
  Gene Name: brevican;
  ENSP ID: ENSP00000392731
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDD

SEQ ID NO: 9651 - protein, 231 aa, Homo sapiens
  Payload ID: 1960;
  Gene Symbol: BCAN;
  Gene Name: brevican;
  ENSP ID: ENSP00000401709
MAQLFLPLLAALVLAQAPAALADVLEGDSSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLF

SEQ ID NO: 9652 - protein, 26 aa, Homo sapiens
  Payload ID: 1960;
  Gene Symbol: BCAN;
  Gene Name: brevican;
  ENSP ID: ENSP00000476259
  MOD_RES (1)..(1): Any amino acid
XHGIDDSSDAVEVKVKGGGHSTHNLT

SEQ ID NO: 9653 - protein, 196 aa, Homo sapiens
  Payload ID: 1960;
  Gene Symbol: BCAN;
  Gene Name: brevican;
  ENSP ID: ENSP00000476509
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGIPSRPHERPVTETWMASPGSGTMVWWTRMTSMMCTVMLKT

SEQ ID NO: 9654 - protein, 562 aa, Homo sapiens
  Payload ID: 1961;
  Gene Symbol: BRF1;
  Gene Name: BRF1, RNA polymerase III transcription initiation  factor 90 kDa subunit;
  Uniprot ID:  Q92994;
  ENSP ID: ENSP00000329029
MAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 9655 - protein, 134 aa, Homo sapiens [sequence omitted]

SEQ ID NO: 9656 - protein, 650 aa, Homo sapiens
  Payload ID: 1961;
  Gene Symbol: BRF1;
  Gene Name: BRF1, RNA polymerase III transcription initiation  factor 90 kDa subunit;
  Uniprot ID:  Q92994;
  ENSP ID: ENSP00000369269
MTGRVCRGCGGTDIELDAARGDAVCTACGSVLEDNIIVSEVQFVESSGGGSSAVGQFVSLDGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 9657 - protein, 473 aa, Homo sapiens
  Payload ID: 1961;
  Gene Symbol: BRF1;
  Gene Name: BRF1, RNA polymerase III transcription initiation  factor 90 kDa subunit;
  Uniprot ID:  Q92994;
  ENSP ID: ENSP00000376340
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 9658 - protein, 584 aa, Homo sapiens
  Payload ID: 1961;
  Gene Symbol: BRF1;
  Gene Name: BRF1, RNA polymerase III transcription initiation  factor 90 kDa subunit;
  Uniprot ID:  Q92994;
  ENSP ID: ENSP00000388877
MAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRRDLSMPRCAKAKSQPHFPVLAQYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 9659 - protein, 439 aa, Homo sapiens
  Payload ID: 1961;
  Gene Symbol: BRF1;
  Gene Name: BRF1, RNA polymerase III transcription initiation  factor 90 kDa subunit;
  Uniprot ID:  Q92994;
  ENSP ID: ENSP00000389859
MHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 9660 - protein, 208 aa, Homo sapiens
  Payload ID: 1961;
  Gene Symbol: BRF1;
  Gene Name: BRF1, RNA polymerase III transcription initiation  factor 90 kDa subunit;
  Uniprot ID:  Q92994;
  ENSP ID: ENSP00000446707
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVDSLRPASFPTWGCDLGVVTRVVTGVYPRCLHASQWPVCAACPVRKFWSVG

SEQ ID NO: 9661 - protein, 161 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000446901
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAPHRGGRADGGPRASPGLFVGRPQYHS

SEQ ID NO: 9662 - protein, 14 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000447521
MTALRLLQRMKRDW

SEQ ID NO: 9663 - protein, 677 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000448387
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 9664 - protein, 234 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000448723
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDP

SEQ ID NO: 9665 - protein, 63 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000448823
MAVSRHLTRGRKMAHVIAACLYLVCRTEGTPHMLLDLSDLLQVNVYVLGKTFLLLARELCINA

SEQ ID NO: 9666 - protein, 45 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000449173
MTALRLLQRMKRDWMHTGRRPSGLCGAALLVAARMHDFRRTVKEV

SEQ ID NO: 9667 - protein, 155 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000449788
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSL

SEQ ID NO: 9668 - protein, 185 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000450258
  MOD_RES (1)..(1): Any amino acid
XGQFVSLDGAGKTPTLGGGFHVNLGKESRAQTLQNDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIE

SEQ ID NO: 9669 - protein, 184 aa, Homo sapiens
  Payload ID: 1961;
  Gene Symbol: BRF1;
  Gene Name: BRF1, RNA polymerase III transcription initiation  factor 90 kDa subunit;
  ENSP ID: ENSP00000480452
MTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSPPSRREGRRRPESLPRPLRGKAPVPLVGGLSSGMAAPDVAEGASPCVLRRGWP

SEQ ID NO: 9670 - protein, 419 aa, Homo sapiens
  Payload ID: 1962;
  Gene Symbol: BRF2;
  Gene Name: BRF2, RNA polymerase III transcription initiation  factor 50 kDa subunit;
  Uniprot ID:  Q9HAW0;
  ENSP ID: ENSP00000220659
MPGRGRCPDCGSTELVEDSHYSQSQLVCSDCGCVVTEGVLTTTFSDEGNLREVTYSRSTGENEQVSRSQQRGLRRVRDLCRVLQLPPTFEDTAVAYYQQAYRHSGIRAARLQKKEVLVGCCVLITCRQHNWPLTMGAICTLLYADLDVFSSTYMQIVKLLGLDVPSLCLAELVKTYCSSFKLFQASPSVPAKYVEDKEKMLSRTMQLVELANETWLVTGRHPLPVITAATFLAWQSLQPADRLSCSLARFCKLANVDLPYPASSRLQELLAVLLRMAEQLAWLRVLRLDKRSVVKHIGDLLQHRQSLVRSAFRDGTAEVETREKEPPGWGQGQGEGEVGNNSLGLPQGKRPASPALLLPPCMLKSPKRICPVPPVSTVTGDENISDSEIEQYLRTPQEVRDFQRAQAARQAATSVPNPP

SEQ ID NO: 9671 - protein, 72 aa, Homo sapiens
  Payload ID: 1962;
  Gene Symbol: BRF2;
  Gene Name: BRF2, RNA polymerase III transcription initiation  factor 50 kDa subunit;
  ENSP ID: ENSP00000429554
MPGRGRCPDCGSTELVEDSHYSQSQLVCSDCGCVVTEGVLTTTFSDEGNLREVTYSRSTGENEQVSRSQQRE

SEQ ID NO: 9672 - protein, 202 aa, Homo sapiens
  Payload ID: 1962;
  Gene Symbol: BRF2;
  Gene Name: BRF2, RNA polymerase III transcription initiation  factor 50 kDa subunit;
  ENSP ID: ENSP00000430107
MPGRGRCPDCGSTELVEDSHYSQSQLVCSDCGCVVTEGVLTTTFSDEGNLREVTYSRSTGENEQVSRSQQRGLRRVRDLCRVLQLPPTFEDTAVAYYQQAYRHSGIRAARLQKKEVLVGCCVLITCRQHNWPLTMGAICTLLYADLDVFSSTYMQIVKLLGLDVPSLCLAELVKTYCSSLECSGTIIAHCSLELMGSSDLPT

SEQ ID NO: 9673 - protein, 72 aa, Homo sapiens; identical to SEQ ID NO: 9671
  Payload ID: 1962;
  Gene Symbol: BRF2;
  Gene Name: BRF2, RNA polymerase III transcription initiation  factor 50 kDa subunit;
  ENSP ID: ENSP00000430193

SEQ ID NO: 9674 - protein, 251 aa, Homo sapiens
  Payload ID: 1963;
  Gene Symbol: BRI3BP;
  Gene Name: BRI3 binding prt;
  Uniprot ID:  Q8WY22;
  ENSP ID: ENSP00000340761
MGARASGGPLARAGLLLLLLLLLLLGLLAPGAQGARGRGGAEKNSYRRTVNTFSQSVSSLFGEDNVRAAQKFLARLTERFVLGVDMFVETLWKVWTELLDVLGLDVSNLSQYFSPASVSSSPARALLLVGVVLLAYWFLSLTLGFTFSVLHVVFGRFFWIVRVVLFSMSCVYILHKYEGEPENAVLPLCFVVAVYFMTGPMGFYWRSSPSGPSNPSNPSVEEKLEHLEKQVRLLNIRLNRVLESLDRSKDK

SEQ ID NO: 9675 - protein, 228 aa, Homo sapiens
  Payload ID: 1964;
  Gene Symbol: BRICD5;
  Gene Name: BRICHOS domain containing 5;
  Uniprot ID:  Q6PL45;
  ENSP ID: ENSP00000332389
MEPASCCAERPKPGPTGVKTKPSCGGWRAVSLLLLLLLLVLAAVGVVAGGLLGSAQGPPKPRLQTLRMTLPSPHMPRPNQTILVDVARNAATITVTPPQSNHSWAVLFDGQSGCICYRPEEHQVCFLRLMEDSDRETLRLLVDTSKVQEAWVPSQDTHHTQELLAVQGSLEVDPAQAGALVQRLCMRTPIYWARRAEGPRRQRLIYLCIDICFPSNICVSVCFYYLPD

SEQ ID NO: 9676 - protein, 260 aa, Homo sapiens
  Payload ID: 1964;
  Gene Symbol: BRICD5;
  Gene Name: BRICHOS domain containing 5;
  Uniprot ID:  Q6PL45;
  ENSP ID: ENSP00000455052
MEPASCCAERPKPGPTGVKTKPSCGGWRAVSLLLLLLLLVLAAVGVVAGGLLGSAQGPPKPRLQTLRMTLPSPHMPRPNQTILVDVARNAATITVTPPQSNHSWAVLFDGQSGCICYRPEEHQVCFLRLMEDSDRETLRLLVDTSKVQEAWVPSQDTHHTQELLAVQGSLEVDPAQAGALVQRLCMRTPIYWARRAEGESGPLWGKARPSGWFEELGAEPLEIHGTLATGPRRQRLIYLCIDICFPSNICVSVCFYYLPD

SEQ ID NO: 9677 - protein, 153 aa, Homo sapiens
  Payload ID: 1964;
  Gene Symbol: BRICD5;
  Gene Name: BRICHOS domain containing 5;
  ENSP ID: ENSP00000457969
MEPASCCAERPKPGPTGVKTKPSCGGWRAVSLLLLLLLLVLAAVGVVAGGLLGSAQGPPKPRLQTLRMTLPSPHMPRPNQTILVDVARNAATITVTPPQSNHSWAVLFDGQSVSGQGGVTLAGVGLGGPASPPCLPRAASVTALRSTRSASSA

SEQ ID NO: 9678 - protein, 75 aa, Homo sapiens
  Payload ID: 1965;
  Gene Symbol: BRK1;
  Gene Name: BRICK1, SCAR/WAVE actin-nucleating complex subunit;
  Uniprot ID:  Q8WUW1;
  ENSP ID: ENSP00000432472
MAGQEDPVQREIHQDWANREYIEIITSSIKKIADFLNSFDMSCRSRLATLNEKLTALERRIEYIEARVTKGETLT

SEQ ID NO: 9679 - protein, 409 aa, Homo sapiens
  Payload ID: 1966;
  Gene Symbol: BIN1;
  Gene Name: bridging integrator 1;
  Uniprot ID:  O00499;
  ENSP ID: ENSP00000259237
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9680 - protein, 497 aa, Homo sapiens
  Payload ID: 1966;
  Gene Symbol: BIN1;
  Gene Name: bridging integrator 1;
  Uniprot ID:  O00499;
  ENSP ID: ENSP00000259238
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQLRKGPPVPPPPKHTPSKEVKQEQILSLFEDTFVPEISVTTPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9681 - protein, 454 aa, Homo sapiens
  Payload ID: 1966;
  Gene Symbol: BIN1;
  Gene Name: bridging integrator 1;
  Uniprot ID:  O00499;
  ENSP ID: ENSP00000315284
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9682 - protein, 506 aa, Homo sapiens
  Payload ID: 1966;
  Gene Symbol: BIN1;
  Gene Name: bridging integrator 1;
  Uniprot ID:  O00499;
  ENSP ID: ENSP00000315388
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9683 - protein, 518 aa, Homo sapiens
  Payload ID: 1966;
  Gene Symbol: BIN1;
  Gene Name: bridging integrator 1;
  Uniprot ID:  O00499;
  ENSP ID: ENSP00000315411
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9684 - protein, 593 aa, Homo sapiens
  Payload ID: 1966;
  Gene Symbol: BIN1;
  Gene Name: bridging integrator 1;
  Uniprot ID:  O00499;
  ENSP ID: ENSP00000316779
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9685 - protein, 550 aa, Homo sapiens
  Payload ID: 1966;
  Gene Symbol: BIN1;
  Gene Name: bridging integrator 1;
  Uniprot ID:  O00499;
  ENSP ID: ENSP00000350654
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKPVSLLEKAAPQWCQGKLQAHLVAQTNLLRNQAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQFEAPGPFSEQASLLDLDFDPLPPVTSPVKAPTPSGQSIPWDLWEPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9686 - protein, 424 aa, Homo sapiens
  Payload ID: 1966;
  Gene Symbol: BIN1;
  Gene Name: bridging integrator 1;
  Uniprot ID:  O00499;
  ENSP ID: ENSP00000365281
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPRKKSKLFSRLRRKKNSDNAPAKGNKSPSPPDGSPAATPEIRVNHEPEPAGGATPGATLPKSPSQSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9687 - protein, 482 aa, Homo sapiens
  Payload ID: 1966;
  Gene Symbol: BIN1;
  Gene Name: bridging integrator 1;
  Uniprot ID:  O00499;
  ENSP ID: ENSP00000376760
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQLRKGPPVPPPPKHTPSKEVKQEQILSLFEDTFVPEISVTTPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9688 - protein, 475 aa, Homo sapiens
  Payload ID: 1966;
  Gene Symbol: BIN1;
  Gene Name: bridging integrator 1;
  Uniprot ID:  O00499;
  ENSP ID: ENSP00000376761
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPTESPAGSLPSGEPSAAEGTFAVSWPSQTAEPGPAQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9689 - protein, 439 aa, Homo sapiens
  Payload ID: 1966;
  Gene Symbol: BIN1;
  Gene Name: bridging integrator 1;
  Uniprot ID:  O00499;
  ENSP ID: ENSP00000386797
MAEMGSKGVTAGKIASNVQKKLTRAQEKVLQKLGKADETKDEQFEQCVQNFNKQLTEGTRLQKDLRTYLASVKAMHEASKKLNECLQEVYEPDWPGRDEANKIAENNDLLWMDYHQKLVDQALLTMDTYLGQFPDIKSRIAKRGRKLVDYDSARHHYESLQTAKKKDEAKIAKAEEELIKAQKVFEEMNVDLQEELPSLWNSRVGFYVNTFQSIAGLEENFHKEMSKLNQNLNDVLVGLEKQHGSNTFTVKAQPSDNAPAKGNKSPSPPDGSPAATPEIRVNHEPEPAGGATPGATLPKSPSQPAEASEVAGGTQPAAGAQEPGETAASEAASSSLPAVVVETFPATVNGTVEGGSGAGRLDLPPGFMFKVQAQHDYTATDTDELQLKAGDVVLVIPFQNPEEQDEGWLMGVKESDWNQHKELEKCRGVFPENFTERVP

SEQ ID NO: 9690 - protein, 551 aa, Homo sapiens
  Payload ID: 1967;
  Gene Symbol: BIN2;
  Gene Name: bridging integrator 2;
  ENSP ID: ENSP00000410217
  MOD_RES (1)..(1): Any amino acid
XENHRARGQGGGPQGVGRMAEGKAGGAAGLFAKQVQKKFSRAQEKVLQKLGKAVETKDERFEQSASNFYQQQAEGHKLYKDLKNFLSAVKVMHESSKRVSETLQEIYSSEWDGHEELKAIVWERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISANSSEGQDQLQVSMVPENNNLTAPEPQEEVSTSENPQL

SEQ ID NO: 9691 - protein, 539 aa, Homo sapiens
  Payload ID: 1967;
  Gene Symbol: BIN2;
  Gene Name: bridging integrator 2;
  ENSP ID: ENSP00000445874
MVLQKLGKAVETKDERFEQSASNFYQQQAEGHKLYKDLKNFLSAVKVMHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISANSSEGQDQLQVSMVPENNNLTAPEPQEEVSTSENPQL

SEQ ID NO: 9692 - protein, 73 aa, Homo sapiens
  Payload ID: 1967;
  Gene Symbol: BIN2;
  Gene Name: bridging integrator 2;
  ENSP ID: ENSP00000474425
  MOD_RES (1)..(1): Any amino acid
XARGQGGGPQGVGRMAEGKAGGAAGLFAKQVQKKFSRAQEKVLQKLGKAVETKDERFEQSASNFYQQQFVCLF

SEQ ID NO: 9693 - protein, 536 aa, Homo sapiens
  Payload ID: 1967;
  Gene Symbol: BIN2;
  Gene Name: bridging integrator 2;
  ENSP ID: ENSP00000474972
  MOD_RES (1)..(1): Any amino acid
XGVGRMAEGKAGGAAGLFAKQVQKKFSRAQEKAEGHKLYKDLKNFLSAVKVMHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQTSFKSPWYQKTTTSQHLNLKKRYPQVKIHNSEEKLPRLLLPQTSPEKLFNQRV

SEQ ID NO: 9694 - protein, 597 aa, Homo sapiens
  Payload ID: 1967;
  Gene Symbol: BIN2;
  Gene Name: bridging integrator 2;
  ENSP ID: ENSP00000483983
MRGMPGARTSSSGASENHRARGQGGGPQGVGRMAEGKAGGAAGLFAKQVQKKFSRAQEKVLQKLGKAVETKDERFEQSASNFYQQQAEGHKLYKDLKNFLSAVKVMHESSKRVSETLQEIYSSEWDGHEELKAIVWNNDLLWEDYEEKLADQAVRTMEIYVAQFSEIKERIAKRGRKLVDYDSARHHLEAVQNAKKKDEAKTAKAEEEFNKAQTVFEDLNQELLEELPILYNSRIGCYVTIFQNISNLRDVFYREMSKLNHNLYEVMSKLEKQHSNKVFVVKGLSSSSRRSLVISPPVRTATVSSPLTSPTSPSTLSLKSESESVSATEDLAPDAAQGEDNSEIKELLEEEEIEKEGSEASSSEEDEPLPACNGPAQAQPSPTTERAKSQEEVLPSSTTPSPGGALSPSGQPSSSATEVVLRTRTASEGSEQPKKRASIQRTSAPPSRPPPPRATASPRPSSGNIPSSPTASGGGSPTSPRASLGTGTASPRTSLEVSPNPEPPEKPVRTPEAKENENIHNQNPEELCTSPTLMTSQVASEPGEAKKMEDKEKDNKLISANSSEGQDQLQVSMVPENNNLTAPEPQEEVSTSENPQL

SEQ ID NO: 9695 - protein, 253 aa, Homo sapiens
  Payload ID: 1968;
  Gene Symbol: BIN3;
  Gene Name: bridging integrator 3;
  Uniprot ID:  Q9NQY0;
  ENSP ID: ENSP00000276416
MSWIPFKIGQPKKQIVPKTVERDFEREYGKLQQLEEQTRRLQKDMKKSTDADLAMSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQVVYYSEMHKIFGDLSHQLDQPGHSDEQRERENEAKLSELRALSIVADD

SEQ ID NO: 9696 - protein, 205 aa, Homo sapiens
  Payload ID: 1968;
  Gene Symbol: BIN3;
  Gene Name: bridging integrator 3;
  ENSP ID: ENSP00000382859
MENFSTMSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQVVYYSEMHKIFGDLSHQLDQPGHSDEQRERENEAKLSELRALSIVADD

SEQ ID NO: 9697 - protein, 27 aa, Homo sapiens
  Payload ID: 1968;
  Gene Symbol: BIN3;
  Gene Name: bridging integrator 3;
  ENSP ID: ENSP00000428768
MSWIPFKIGQPKKQIVPKTVSNSIVLL

SEQ ID NO: 9698 - protein, 149 aa, Homo sapiens
  Payload ID: 1968;
  Gene Symbol: BIN3;
  Gene Name: bridging integrator 3;
  ENSP ID: ENSP00000429660
MSWIPFKIGQPKKQIVPKTVERDFEREYGKLQQLEEQTRRLQKDMKKSTDADLAMSKSAVKISLDLLSNPLCEQDQDLLNMVTALDTAMKRMDAFNQEKVNQIQKTVIEPLKKRNQLFWSWVTSEWPQSHELPGLRSLILDTAGLWLAW

SEQ ID NO: 9699 - protein, 199 aa, Homo sapiens
  Payload ID: 1968;
  Gene Symbol: BIN3;
  Gene Name: bridging integrator 3;
  Uniprot ID:  Q9NQY0;
  ENSP ID: ENSP00000430423
MSKSAVKISLDLLSNPLCEQDQDLLNMVTALDTAMKRMDAFNQEKVNQIQKTVIEPLKKFGSVFPSLNMAVKRREQALQDYRRLQAKVEKYEEKEKTGPVLAKLHQAREELRPVREDFEAKNRQLLEEMPRFYGSRLDYFQPSFESLIRAQVVYYSEMHKIFGDLSHQLDQPGHSDEQRERENEAKLSELRALSIVADD

SEQ ID NO: 9700 - protein, 63 aa, Homo sapiens
  Payload ID: 1968;
  Gene Symbol: BIN3;
  Gene Name: bridging integrator 3;
  ENSP ID: ENSP00000430546
MSWIPFKIGQPKKQIVPKTVERDFEREYGKLQQLEEQTRRLQKDMKKSTDADLAPKPQPVTDV

SEQ ID NO: 9701 - protein, 329 aa, Homo sapiens
  Payload ID: 1969;
  Gene Symbol: BABAM1;
  Gene Name: BRISC and BRCA1 A complex member 1;
  Uniprot ID:  Q9NWV8;
  ENSP ID: ENSP00000352408
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 9702 - protein, 254 aa, Homo sapiens
  Payload ID: 1969;
  Gene Symbol: BABAM1;
  Gene Name: BRISC and BRCA1 A complex member 1;
  ENSP ID: ENSP00000407826
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 9703 - protein, 254 aa, Homo sapiens; identical to SEQ ID NO: 9702
  Payload ID: 1969;
  Gene Symbol: BABAM1;
  Gene Name: BRISC and BRCA1 A complex member 1;
  ENSP ID: ENSP00000468834

SEQ ID NO: 9704 - protein, 108 aa, Homo sapiens
  Payload ID: 1969;
  Gene Symbol: BABAM1;
  Gene Name: BRISC and BRCA1 A complex member 1;
  ENSP ID: ENSP00000469527
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVLQNQRPQCLPEDD

SEQ ID NO: 9705 - protein, 97 aa, Homo sapiens
  Payload ID: 1969;
  Gene Symbol: BABAM1;
  Gene Name: BRISC and BRCA1 A complex member 1;
  ENSP ID: ENSP00000470088
  MOD_RES (1)..(1): Any amino acid
XTSGAGPKSWQVPPPAPEVQIRTPRVNCPEKVIICLDLSEEMSLPKLESFNGSKTNALNVSQKMIEMFVRTKHKIDKSHCLNHPCTSAPSCARKSLA

SEQ ID NO: 9706 - protein, 32 aa, Homo sapiens
  Payload ID: 1969;
  Gene Symbol: BABAM1;
  Gene Name: BRISC and BRCA1 A complex member 1;
  ENSP ID: ENSP00000470295
PLQKMFQCPYFFFDVVYIHNGTEEKEEEMSWK

SEQ ID NO: 9707 - protein, 329 aa, Homo sapiens; identical to SEQ ID NO: 9701
  Payload ID: 1969;
  Gene Symbol: BABAM1;
  Gene Name: BRISC and BRCA1 A complex member 1;
  Uniprot ID:  Q9NWV8;
  ENSP ID: ENSP00000470920

SEQ ID NO: 9708 - protein, 225 aa, Homo sapiens
  Payload ID: 1969;
  Gene Symbol: BABAM1;
  Gene Name: BRISC and BRCA1 A complex member 1;
  ENSP ID: ENSP00000471246
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQ

SEQ ID NO: 9709 - protein, 329 aa, Homo sapiens; identical to SEQ ID NO: 9701
  Payload ID: 1969;
  Gene Symbol: BABAM1;
  Gene Name: BRISC and BRCA1 A complex member 1;
  Uniprot ID:  Q9NWV8;
  ENSP ID: ENSP00000471605

SEQ ID NO: 9710 - protein, 218 aa, Homo sapiens
  Payload ID: 1969;
  Gene Symbol: BABAM1;
  Gene Name: BRISC and BRCA1 A complex member 1;
  ENSP ID: ENSP00000471721
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFTFSLAPPPDLEGLFSLIQQKTELPVTENVQTIPPPYV

SEQ ID NO: 9711 - protein, 193 aa, Homo sapiens
  Payload ID: 1969;
  Gene Symbol: BABAM1;
  Gene Name: BRISC and BRCA1 A complex member 1;
  ENSP ID: ENSP00000472425
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFTPPPDLEGLFSL

SEQ ID NO: 9712 - protein, 237 aa, Homo sapiens
  Payload ID: 1969;
  Gene Symbol: BABAM1;
  Gene Name: BRISC and BRCA1 A complex member 1;
  ENSP ID: ENSP00000472585
MLVRLVSNFQPQGRILASPVRVPSSHTGAMEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPP

SEQ ID NO: 9713 - protein, 200 aa, Homo sapiens
  Payload ID: 1969;
  Gene Symbol: BABAM1;
  Gene Name: BRISC and BRCA1 A complex member 1;
  ENSP ID: ENSP00000472632
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTE

SEQ ID NO: 9714 - protein, 181 aa, Homo sapiens
  Payload ID: 1969;
  Gene Symbol: BABAM1;
  Gene Name: BRISC and BRCA1 A complex member 1;
  ENSP ID: ENSP00000473182
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTF

SEQ ID NO: 9715 - protein, 60 aa, Homo sapiens
  Payload ID: 1969;
  Gene Symbol: BABAM1;
  Gene Name: BRISC and BRCA1 A complex member 1;
  ENSP ID: ENSP00000473240
MEVAEPSSPTEEEEEEEEHSAEPRPRTRSNPEGAEDRAVGAQASPLRSKFGHQGSTVQRK

SEQ ID NO: 9716 - protein, 411 aa, Homo sapiens
  Payload ID: 1970;
  Gene Symbol: BROX;
  Gene Name: BRO1 domain and CAAX motif containing;
  Uniprot ID:  Q5VW32;
  ENSP ID: ENSP00000343742
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWRKYLHLKMCFYTAYAYCYHGETLLASDKCGEAIRSLQEAEKLYAKAEALCKEYGETKGPGPTVKPSGHLFFRKLGNLVKNTLEKCQRENGFIYFQKIPTEAPQLELKANYGLVEPIPFEFPPTSVQWTPETLAAFDLTKRPKDDSTKPKPEEEVKPVKEPDIKPQKDTGCYIS

SEQ ID NO: 9717 - protein, 215 aa, Homo sapiens
  Payload ID: 1970;
  Gene Symbol: BROX;
  Gene Name: BRO1 domain and CAAX motif containing;
  ENSP ID: ENSP00000398862
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYE

SEQ ID NO: 9718 - protein, 338 aa, Homo sapiens
  Payload ID: 1970;
  Gene Symbol: BROX;
  Gene Name: BRO1 domain and CAAX motif containing;
  ENSP ID: ENSP00000440041
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWRKYLHLKMCFYTAYAYCYHGETLLASDKCGEAIRSLQEAEKLYAKAEALCKEYGETKGPGPTVKPSGHLFFRKLGNLVKNTLEKCQRENGFILNPNQKKK

SEQ ID NO: 9719 - protein, 379 aa, Homo sapiens
  Payload ID: 1970;
  Gene Symbol: BROX;
  Gene Name: BRO1 domain and CAAX motif containing;
  Uniprot ID:  Q5VW32;
  ENSP ID: ENSP00000441080
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWRKYLHLKMCFYTAYAYCYHGETLLASDKCGEAIRSLQEAEKLYAKAEALCKEYGETKGPGPTVKPSGHLFFRKLGNLVKNTLEKCQRENGFIYFQKIPTEAPQLELKANYGLVEPIPFEFPPTSVQWTPETLAAFDLTKRPKDDSTKPKPEEEVKPVKEPDIKPQKDTGCYIS

SEQ ID NO: 9720 - protein, 379 aa, Homo sapiens; identical to SEQ ID NO: 9719
  Payload ID: 1970;
  Gene Symbol: BROX;
  Gene Name: BRO1 domain and CAAX motif containing;
  Uniprot ID:  Q5VW32;
  ENSP ID: ENSP00000478496

SEQ ID NO: 9721 - protein, 780 aa, Homo sapiens
  Payload ID: 1971;
  Gene Symbol: BAHD1;
  Gene Name: bromo adjacent homology domain containing 1;
  Uniprot ID:  Q8TBE0;
  ENSP ID: ENSP00000396976
MTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGKNYPKAWQGASSGEAAGPPGWQGCPDEPWPSATPCGPSVQPSHQPLSKALESPLGLRPHLPLLMGGQAALKPEPGRPGEESPAPKQELHQPSFPTPQLSPLPMPGNPADYNGLCVGPELTALGSFYLYCGQEGLQCGGYSPCPMLPEGKLSPVAAPHEEGLLLAPSSVPSGTPFQHPPWGSSRYCSSEDTGVNGYSICGVLPLSVTHAGTTCGGCPYKMPFAAEGCRSLGQLEFPLPEAGHPASPAHPLLGCPVPSVPPAAEPVPHLQTPTSEPQTVARACPQSAKPPSGSKSGLRTGSSCRHTARSKAARRPSHPKQPRVQRPRPRRRRRRRTNGWVPVGAACEKAVYVLDEPEPAIRKSYQAVERHGETIRVRDTVLLKSGPRKTSTPYVAKISALWENPESGELMMSLLWYYRPEHLQGGRSPSMHEPLQNEVFASRHQDQNSVACIEEKCYVLTFAEYCRFCAMAKRRGEGLPSRKTALVPPSADYSTPPHRTVPEDTDPELVFLCRHVYDFRHGRILKNPQ

SEQ ID NO: 9722 - protein, 777 aa, Homo sapiens
  Payload ID: 1971;
  Gene Symbol: BAHD1;
  Gene Name: bromo adjacent homology domain containing 1;
  Uniprot ID:  Q8TBE0;
  ENSP ID: ENSP00000454101
MTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGKNYPKAWQGASSGEAAGPPGWQGCPDEPWPSATPCGPSVQPSHQPLSKALESPLGLRPHLPLLMGGQAALKPEPGRPGEESPAPKQELHQPSFPTPQLSPLPMPGNPADYNGLCVGPELTALGSFYLYCGQEGLQCGGYSPCPMLPEGKLSPVAAPHEEGLLLAPSSVPSGTPFQHPPWGSSRYCSSEDTGVNGYSICGVLPLSVTHAGTTCGGCPYKMPFAAEGCRSLGQLEFPLPEAGHPASPAHPLLGCPVPSVPPAAEPVPHLQTPTSEPQTVARACPQSAKPPSGSKSGLRTGSSCRHTARSKAARRPSHPKQPRVQRPRPRRRRRRRTNGWVPVGAACEKAVYVLDEPEPAIRKSYQAVERHGETIRVRDTVLLKSGPRKTSTPYVAKISALWENPESGELMMSLLWYYRPEHLQGGRSPSMHENEVFASRHQDQNSVACIEEKCYVLTFAEYCRFCAMAKRRGEGLPSRKTALVPPSADYSTPPHRTVPEDTDPELVFLCRHVYDFRHGRILKNPQ

SEQ ID NO: 9723 - protein, 779 aa, Homo sapiens
  Payload ID: 1971;
  Gene Symbol: BAHD1;
  Gene Name: bromo adjacent homology domain containing 1;
  Uniprot ID:  Q8TBE0;
  ENSP ID: ENSP00000454150
MTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGKNYPKAWQGASSGEAAGPPGWQGCPDEPWPSATPCGPSVQPSHQPLSKALESPLGLRPHLPLLMGGQAALKPEPGRPGEESPAPKQELHQPSFPTPQLSPLPMPGNPADYNGLCVGPELTALGSFYLYCGQEGLQCGGYSPCPMLPEGKLSPVAAPHEEGLLLAPSSVPSGTPFQHPPWGSSRYCSSEDTGVNGYSICGVLPLSVTHAGTTCGGCPYKMPFAAGCRSLGQLEFPLPEAGHPASPAHPLLGCPVPSVPPAAEPVPHLQTPTSEPQTVARACPQSAKPPSGSKSGLRTGSSCRHTARSKAARRPSHPKQPRVQRPRPRRRRRRRTNGWVPVGAACEKAVYVLDEPEPAIRKSYQAVERHGETIRVRDTVLLKSGPRKTSTPYVAKISALWENPESGELMMSLLWYYRPEHLQGGRSPSMHEPLQNEVFASRHQDQNSVACIEEKCYVLTFAEYCRFCAMAKRRGEGLPSRKTALVPPSADYSTPPHRTVPEDTDPELVFLCRHVYDFRHGRILKNPQ

SEQ ID NO: 9724 - protein, 1524 aa, Homo sapiens
  Payload ID: 1972;
  Gene Symbol: BAZ1A;
  Gene Name: bromodomain adjacent to zinc finger domain, 1A;
  Uniprot ID:  Q9NRL2;
  ENSP ID: ENSP00000351555
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 9725 - protein, 1556 aa, Homo sapiens
  Payload ID: 1972;
  Gene Symbol: BAZ1A;
  Gene Name: bromodomain adjacent to zinc finger domain, 1A;
  Uniprot ID:  Q9NRL2;
  ENSP ID: ENSP00000353458
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQDFSYFFPDDPPTFIFSPANRRRGRPPKRIHISQEDNVANKQTLASYRSKATKERDKLLKQEEMKSLAFEKAKLKREKADALEAKKKEKEDKEKKREELKKIVEEERLKKKEEKERLKVEREKEREKLREEKRKYVEYLKQWSKPREDMECDDLKELPEPTPVKTRLPPEIFGDALMVLEFLNAFGELFDLQDEFPDGVTLEVLEEALVGNDSEGPLCELLFFFLTAIFQAIAEEEEEVAKEQLTDADTKDLTEALDEDADPTKSALSAVASLAAAWPQLHQGCSLKSLDLDSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGKRGQNGFKEFTRQEQINCVTREPLTADEEEALKQEHQRKEKELLEKIQSAIACTNIFPLGRDRMYRRYWIFPSIPGLFIEEDYSGLTEDMLLPRPSSFQNNVQSQDPQVSTKTGEPLMSESTSNIDQGPRDHSVQLPKPVHKPNRWCFYSSCEQLDQLIEALNSRGHRESALKETLLQEKSRICAQLARFSEEKFHFSDKPQPDSKPTYSRGRSSNAYDPSQMCAEKQLELRLRDFLLDIEDRIYQGTLGAIKVTDRHIWRSALESGRYELLSEENKENGIIKTVNEDVEEMEIDEQTKVIVKDRLLGIKTETPSTVSTNASTPQSVSSVVHYLAMALFQIEQGIERRFLKAPLDASDSGRSYKTVLDRWRESLLSSASLSQVFLHLSTLDRSVIWSKSILNARCKICRKKGDAENMVLCDGCDRGHHTYCVRPKLKTVPEGDWFCPECRPKQRSRRLSSRQRPSLESDEDVEDSMGGEDDEVDGDEEEGQSEEEEYEVEQDEDDSQEEEEVSLPKRGRPQVRLPVKTRGKLSSSFSSRGQQQEPGRYPSRSQQSTPKTTVSSKTGRSLRKINSAPPTETKSLRIASRSTRHSHGPLQADVFVELLSPRRKRRGRKSANNTPENSPNFPNFRVIATKSSEQSRSVNIASKLSLQESESKRRCRKRQSPEPSPVTLGRRSSGRQGGVHELSAFEQLVVELVRHDDSWPFLKLVSKIQVPDYYDIIKKPIALNIIREKVNKCEYKLASEFIDDIELMFSNCFEYNPRNTSEAKAGTRLQAFFHIQAQKLGLHVTPSNVDQVSTPPAAKKSRI

SEQ ID NO: 9726 - protein, 1556 aa, Homo sapiens; identical to SEQ ID NO: 9725
  Payload ID: 1972;
  Gene Symbol: BAZ1A;
  Gene Name: bromodomain adjacent to zinc finger domain, 1A;
  Uniprot ID:  Q9NRL2;
  ENSP ID: ENSP00000371859

SEQ ID NO: 9727 - protein, 12 aa, Homo sapiens
  Payload ID: 1972;
  Gene Symbol: BAZ1A;
  Gene Name: bromodomain adjacent to zinc finger domain, 1A;
  ENSP ID: ENSP00000450902
  MOD_RES (1)..(1): Any amino acid
XRKRQSPGPRLL

SEQ ID NO: 9728 - protein, 76 aa, Homo sapiens
  Payload ID: 1972;
  Gene Symbol: BAZ1A;
  Gene Name: bromodomain adjacent to zinc finger domain, 1A;
  ENSP ID: ENSP00000450923
  MOD_RES (1)..(1): Any amino acid
XLLGIKTETPSTVSTNASTPQSVSSVVHYLAMALFQIEQGIERRFLKAPLGKTEINKDQKGDRKKKGQEKERGRSI

SEQ ID NO: 9729 - protein, 77 aa, Homo sapiens
  Payload ID: 1972;
  Gene Symbol: BAZ1A;
  Gene Name: bromodomain adjacent to zinc finger domain, 1A;
  ENSP ID: ENSP00000451896
  MOD_RES (1)..(1): Any amino acid
XYVKDRYFVEETVEVIRNNGARLQCRILEVLPPSHQNGFANGHVNSVDGETIIISDSDDSETQSCSFQNGFPLLTAK

SEQ ID NO: 9730 - protein, 218 aa, Homo sapiens
  Payload ID: 1972;
  Gene Symbol: BAZ1A;
  Gene Name: bromodomain adjacent to zinc finger domain, 1A;
  ENSP ID: ENSP00000480380
  MOD_RES (1)..(1): Any amino acid
XSCTLSEILRLHILASGADVTSANAKYRYQKRGGFDATDDACMELRLSNPSLVKKLSSTSVYDLTPGEKMKILHALCGKLLTLVSTRDFIEDYVDILRQAKQEFRELKAEQHRKEREEAAARIRKRKEEKLKEQEQKMKEKQEKLKEDEQRNSTADISIGEEEREDFDTSIESKDTEQKELDQDMVTEDEDDPGSHKRGRRGNTEISLGHSCVFVFNQ

SEQ ID NO: 9731 - protein, 1483 aa, Homo sapiens
  Payload ID: 1973;
  Gene Symbol: BAZ1B;
  Gene Name: bromodomain adjacent to zinc finger domain, 1B;
  Uniprot ID:  Q9UIG0;
  ENSP ID: ENSP00000342434
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 9732 - protein, 1483 aa, Homo sapiens; identical to SEQ ID NO: 9731
  Payload ID: 1973;
  Gene Symbol: BAZ1B;
  Gene Name: bromodomain adjacent to zinc finger domain, 1B;
  Uniprot ID:  Q9UIG0;
  ENSP ID: ENSP00000385442

SEQ ID NO: 9733 - protein, 1875 aa, Homo sapiens
  Payload ID: 1974;
  Gene Symbol: BAZ2A;
  Gene Name: bromodomain adjacent to zinc finger domain, 2A;
  ENSP ID: ENSP00000368754
MEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 9734 - protein, 1905 aa, Homo sapiens
  Payload ID: 1974;
  Gene Symbol: BAZ2A;
  Gene Name: bromodomain adjacent to zinc finger domain, 2A;
  Uniprot ID:  Q9UIF9;
  ENSP ID: ENSP00000446880
MEMEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 9735 - protein, 116 aa, Homo sapiens
  Payload ID: 1974;
  Gene Symbol: BAZ2A;
  Gene Name: bromodomain adjacent to zinc finger domain, 2A;
  ENSP ID: ENSP00000447248
MEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSG

SEQ ID NO: 9736 - protein, 162 aa, Homo sapiens
  Payload ID: 1974;
  Gene Symbol: BAZ2A;
  Gene Name: bromodomain adjacent to zinc finger domain, 2A;
  ENSP ID: ENSP00000447314
  MOD_RES (1)..(1): Any amino acid
XNAAPTPPPAVSEDQPTPSPQQLASSKPMNRPSAANPCSPVQFSSTPLAGLAPKRRAGDPGEMPQSPTGLGQPKRRGRPPKMCSGWWWIRDPEMLDAMLKALHPRGIREKALHKHLNKHRDFLQEVCLRPSADPIFEPRQLPAFQEGIMSWSPKEKTYETDL

SEQ ID NO: 9737 - protein, 277 aa, Homo sapiens
  Payload ID: 1974;
  Gene Symbol: BAZ2A;
  Gene Name: bromodomain adjacent to zinc finger domain, 2A;
  ENSP ID: ENSP00000447591
  MOD_RES (1)..(1): Any amino acid
XLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGAHVLLWQVAERGAHQEGQPPMAGGDLVLWPLWEEDEAISRSDQVPEPQRGTQCPPRALQLQSPYACWRFL

SEQ ID NO: 9738 - protein, 1903 aa, Homo sapiens
  Payload ID: 1974;
  Gene Symbol: BAZ2A;
  Gene Name: bromodomain adjacent to zinc finger domain, 2A;
  ENSP ID: ENSP00000447941
MEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQPSSPSHNTNLRAGSQEFWANGTQSPMGLNFDSQELYDSFPDQNFEVMPNGPPSFFTSPQTSPMLGSSIQTFAPSQEVGSGIHPDEAAEKEMTSVVAENGTGLVGSLELEEEQPELKMCGYNGSVPSVESLHQEVSVLVPDPTVSCLDDPSHLPDQLEDTPILSEDSLEPFNSLAPEPVSGGLYGIDDTELMGAEDKLPLEDSPVISALDCPSLNNATAFSLLADDSQTSTSIFASPTSPPVLGESVLQDNSFDLNNGSDAEQEEMETQSSDFPPSLTQPAPDQSSTIQLHPATSPAVSPTTSPAVSLVVSPAASPEISPEVCPAASTVVSPAVFSVVSPASSAVLPAVSLEVPLTASVTSPKASPVTSPAAAFPTASPANKDVSSFLETTADVEEITGEGLTASGSGDVMRRRIATPEEVRLPLQHGWRREVRIKKGSHRWQGETWYYGPCGKRMKQFPEVIKYLSRNVVHSVRREHFSFSPRMPVGDFFEERDTPEGLQWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEKVKMKEKEEVTKAKPACKADKTLATQRRLEERQRQQMILEEMKKPTEDMCLTDHQPLPDFSRVPGLTLPSGAFSDCLTIVEFLHSFGKVLGFDPAKDVPSLGVLQEGLLCQGDSLGEVQDLLVRLLKAALHDPGFPSYCQSLKILGEKVSEIPLTRDNVSEILRCFLMAYGVEPALCDRLRTQPFQAQPPQQKAAVLAFLVHELNGSTLIINEIDKTLESMSSYRKNKWIVEGRLRRLKTVLAKRTGRSEVEMEGPEECLGRRRSSRIMEETSGMEEEEEEESIAAVPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPEMCSGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 9739 - protein, 837 aa, Homo sapiens
  Payload ID: 1974;
  Gene Symbol: BAZ2A;
  Gene Name: bromodomain adjacent to zinc finger domain, 2A;
  ENSP ID: ENSP00000448760
VPGRRGRRDGEVDATASSIPELERQIEKLSKRQLFFRKKLLHSSQMLRAVSLGQDRYRRRYWVLPYLAGIFVEGTEGNLVPEEVIKKETDSLKVAAHASLNPALFSMKMELAGSNTTASSPARARGRPRKTKPGSMQPRHLKSPVRGQDSEQPQAQLQPEAQLHAPAQPQPQLQLQLQSHKGFLEQEGSPLSLGQSQHDLSQSAFLSWLSQTQSHSSLLSSSVLTPDSSPGKLDPAPSQPPEEPEPDEAESSPDPQALWFNISAQMPCNAAPTPPPAVSEDQPTPSPQQLASSKPMNRPSAANPCSPVQFSSTPLAGLAPKRRAGDPGEMPQSPTGLGQPKRRGRPPSKFFKQMEQRYLTQLTAQPVPPGWWWIRDPEMLDAMLKALHPRGIREKALHKHLNKHRDFLQEVCLRPSADPIFEPRQLPAFQEGIMSWSPKEKTYETDLAVLQWVEELEQRVIMSDLQIRGWTCPSPDSTREDLAYCEHLSDSQEDITWRGRGREGLAPQRKTTNPLDLAVMRLAALEQNVERRYLREPLWPTHEVVLEKALLSTPNGAPEGTTTEISYEITPRIRVWRQTLERCRSAAQVCLCLGQLERSIAWEKSVNKVTCLVCRKGDNDEFLLLCDGCDRGCHIYCHRPKMEAVPEGDWFCTVCLAQQVEGEFTQKPGFPKRGQKRKSGYSLNFSEGDGRRRRVLLRGRESPAAGPRYSEEGLSPSKRRRLSMRNHHSDLTFCEIILMEMESHDAAWPFLEPVNPRLVSGYRRIIKNPMDFSTMRERLLRGGYTSSEEFAADALLVFDNCQTFNEDDSEVGKAGHIMRRFFESRWEEFYQGKQANL

SEQ ID NO: 9740 - protein, 205 aa, Homo sapiens
  Payload ID: 1974;
  Gene Symbol: BAZ2A;
  Gene Name: bromodomain adjacent to zinc finger domain, 2A;
  ENSP ID: ENSP00000449473
  MOD_RES (1)..(1): Any amino acid
XWQGETWYYGPCGKRMKQFPEVIKYLSRNVVHSVRREHFSFSPRMPVGDFFEERDTPEWVQLSAEEIPSRIQAITGKRGRPRNTEKAKTKEVPKVKRGRGRPPKVKITELLNKTDNRPLKKLEAQETLNEEDKAKIAKSKKKMRQKVQRGECQTTIQGQARNKRKQETKSLKQKEAKKKSKAEKEKGKTKQEKLKEKVKREKKEK

SEQ ID NO: 9741 - protein, 131 aa, Homo sapiens
  Payload ID: 1974;
  Gene Symbol: BAZ2A;
  Gene Name: bromodomain adjacent to zinc finger domain, 2A;
  ENSP ID: ENSP00000449496
MEANDHFNFTGLPPAPAASGLKPSPSSGEGLYTNGSPMNFPQQGKSLNGDVNVNGLSTVSHTTTSGILNSAPHSSSTSHLHHPSVAYDCLWNYSQYPSANPGSNLKDPPLLSQFSGGQYPLNGILGGSRQP

SEQ ID NO: 9742 - protein, 211 aa, Homo sapiens
  Payload ID: 1975;
  Gene Symbol: BAZ2B;
  Gene Name: bromodomain adjacent to zinc finger domain, 2B;
  ENSP ID: ENSP00000294905
  MOD_RES (1)..(1): Any amino acid
XIQQIRMEKELRAQQILEAKKKKKEEAANAKLLEAEKRIKEKEMRRQQAVLLKHQELERHRLDMERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDP

SEQ ID NO: 9743 - protein, 643 aa, Homo sapiens
  Payload ID: 1975;
  Gene Symbol: BAZ2B;
  Gene Name: bromodomain adjacent to zinc finger domain, 2B;
  ENSP ID: ENSP00000339670
MGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMLLRRSGSKKNR

SEQ ID NO: 9744 - protein, 2132 aa, Homo sapiens
  Payload ID: 1975;
  Gene Symbol: BAZ2B;
  Gene Name: bromodomain adjacent to zinc finger domain, 2B;
  Uniprot ID:  Q9UIF8;
  ENSP ID: ENSP00000376533
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSSSTLTSSPHSGTSKRRRVTDERELRIPLEYGWQRETRIRNFGGRLQGEVAYYAPCGKKLRQYPEVIKGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 9745 - protein, 2168 aa, Homo sapiens
  Payload ID: 1975;
  Gene Symbol: BAZ2B;
  Gene Name: bromodomain adjacent to zinc finger domain, 2B;
  Uniprot ID:  Q9UIF8;
  ENSP ID: ENSP00000376534
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPGAEWWRTTDAHTRTGATFFPPLLGIPPLFAPPAQNHDSSSFHSRTSGKSNRNGPEKGVNGSINGSNTSSVIGINTSVLSTTASSSMGQTKSTSSGGGNRKCNQEQSKNQPLDARVDKIKDKKPRKKAMESSSNSDSDSGTSSDTSSEGISSSDSDDLEEDEEEEDQSIEESEDDDSDSESEAQHKSNNQVLLHGISDPKADGQKATEKAQEKRIHQPLPLASESQTHSFQSQQKQPQVLSQQLPFIFQSSQAKEESVNKHTSVIQSTGLVSNVKPLSLVNQAKKETYMKLIVPSPDVLKAGNKNTSEESSLLTSELRSKREQYKQAFPSQLKKQESSKSLKKVIAALSNPKATSSSPAHPKQTLENNHPNPFLTNALLGNHQPNGVIQSVIQEAPLALTTKTKMQSKINENIAAASSTPFSSPVNLSTSGRRTPGNQTPVMPSASPILHSQGKEKAVSNNVNPVKTQHHSHPAKSLVEQFRGTDSDIPSSKDSEDSNEDEEEDDEEEDEEDDEDDESDDSQSESDSNSESDTEGSEEEDDDDKDQDESDSDTEGEKTSMKLNKTTSSVKSPSMSLTGHSTPRNLHIAKAPGSAPAALCSESQSPAFLGTSSSTLTSSPHSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREESRMRRRKGRPPNVGNAEFLDNADAKLLRKLQAQEIARQAAQIKLLRKLQKQEQARVAKEAKKQQAIMAAEEKRKQKEQIKIMKQQEKIKRIQQIRMEKELRAQQILEAKKKKKEEAANAKLLEAEKRIKEKEMRRQQAVLLKHQERERRRQHMMLMKAMEARKKAEEKERLKQEKRDEKRLNKERKLEQRRLELEMAKELKKPNEDMCLADQKPLPELPRIPGLVLSGSTFSDCLMVVQFLRNFGKVLGFDVNIDVPNLSVLQEGLLNIGDSMGEVQDLLVRLLSAAVCDPGLITGYKAKTALGEHLLNVGVNRDNVSEILQIFMEAHCGQTELTESLKTKAFQAHTPAQKASVLAFLINELACSKSVVSEIDKNIDYMSNLRRDKWVVEGKLRKLRIIHAKKTGKRDTSGGIDLGEEQHPLGTPTPGRKRRRKGGDSDYDDDDDDDSDDQGDEDDEDEEDKEDKKGKKTDICEDEDEGDQAASVEELEKQIEKLSKQQSQYRRKLFDASHSLRSVMFGQDRYRRRYWILPQCGGIFVEGMESGEGLEEIAKEREKLKKAESVQIKEEMFETSGDSLNCSNTDHCEQKEDLKEKDNTNLFLQKPGSFSKLSKLLEVAKMPPESEVMTPKPNAGANGCTLSYQNSGKHSLGSVQSTATQSNVEKADSNNLFNTGSSGPGKFYSPLPNDQLLKTLTEKNRQWFSLLPRTPCDDTSLTHADMSTASLVTPQSQPPSKSPSPTPAPLGSSAQNPVGLNPFALSPLQVKGGVSMMGLQFCGWPTGVVTSNIPFTSSVPSLGSGLGLSEGNGNSFLTSNVASSKSESPVPQNEKATSAQPAAVEVAKPVDFPSPKPIPEEMQFGWWRIIDPEDLKALLKVLHLRGIREKALQKQIQKHLDYITQACLKNKDVAIIELNENEENQVTRDIVENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRIEEDIAPGLRVWRRALSEARSAAQVALCIQQLQKSIAWEKSIMKVYCQICRKGDNEELLLLCDGCDKGCHTYCHRPKITTIPDGDWFCPACIAKASGQTLKIKKLHVKGKKTNESKKGKKVTLTGDTEDEDSASTSSSLKRGNKDLKKRKMEENTSINLSKQESFTSVKKPKRDDSKDLALCSMILTEMETHEDAWPFLLPVNLKLVPGYKKVIKKPMDFSTIREKLSSGQYPNLETFALDVRLVFDNCETFNEDDSDIGRAGHNMRKYFEKKWTDTFKVS

SEQ ID NO: 9746 - protein, 194 aa, Homo sapiens
  Payload ID: 1975;
  Gene Symbol: BAZ2B;
  Gene Name: bromodomain adjacent to zinc finger domain, 2B;
  ENSP ID: ENSP00000393565
  MOD_RES (1)..(1): Any amino acid
XNNVNPVKTQHHSHPAKSLVEQFRGTDSDIPSSKDSEDSNEDEEEDDEEEDEEDDEDDESDDSQSGTSKRRRVTDERELRIPLEYGWQRETRIRNFGGRLQGEVAYYAPCGKKLRQYPEVIKYLSRNGIMDISRDNFSFSAKIRVGDFYEARDGPQGMQWCLLKEEDVIPRIRAMEGRRGRPPNPDRQRAREES

SEQ ID NO: 9747 - protein, 179 aa, Homo sapiens
  Payload ID: 1975;
  Gene Symbol: BAZ2B;
  Gene Name: bromodomain adjacent to zinc finger domain, 2B;
  ENSP ID: ENSP00000400505
VENWSVEEQAMEMDLSVLQQVEDLERRVASASLQVKGWMCPEPASEREDLVYFEHKSFTKLCKEHDGEFTGEDESSAHALERKSDNPLDIAVTRLADLERNIERRYLKSPLSTTIQIKLDNVGTVTVPAPAPSVSGDGDGIEEDIAPGLRVWRRALSEARSAAQVALCIQQLQKSIAWE

SEQ ID NO: 9748 - protein, 142 aa, Homo sapiens
  Payload ID: 1975;
  Gene Symbol: BAZ2B;
  Gene Name: bromodomain adjacent to zinc finger domain, 2B;
  ENSP ID: ENSP00000415613
MESGERLPSSAASSTTPTSSSTPSVASVVSKGGLSTGVASLSSTINPCGHLFRTAGDQPFNLSTVSSAFPMVSHPVFGLHSASSGHSEFGGLGTLGTPTALAAHPQLASFPGAEWWRTTDAHTRTGATFFPPLLGIPPLFAP

SEQ ID NO: 9749 - protein, 95 aa, Homo sapiens
  Payload ID: 1975;
  Gene Symbol: BAZ2B;
  Gene Name: bromodomain adjacent to zinc finger domain, 2B;
  ENSP ID: ENSP00000441341
MESGERLPSSAASSTTPTSSSTPSVASVVSKGGLSTGVASLSSTINPCGVNGSINGSNTSSVIGINTSVLSTTASSSMGQTKSTSSGGGNRKCNQ

SEQ ID NO: 9750 - protein, 1220 aa, Homo sapiens
  Payload ID: 1976;
  Gene Symbol: BRPF1;
  Gene Name: bromodomain and PHD finger containing, 1;
  Uniprot ID:  P55201;
  ENSP ID: ENSP00000373340
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLAVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVTELDEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 9751 - protein, 1213 aa, Homo sapiens
  Payload ID: 1976;
  Gene Symbol: BRPF1;
  Gene Name: bromodomain and PHD finger containing, 1;
  Uniprot ID:  P55201;
  ENSP ID: ENSP00000398863
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLAVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 9752 - protein, 1119 aa, Homo sapiens
  Payload ID: 1976;
  Gene Symbol: BRPF1;
  Gene Name: bromodomain and PHD finger containing, 1;
  Uniprot ID:  P55201;
  ENSP ID: ENSP00000402485
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLAVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 9753 - protein, 105 aa, Homo sapiens
  Payload ID: 1976;
  Gene Symbol: BRPF1;
  Gene Name: bromodomain and PHD finger containing, 1;
  ENSP ID: ENSP00000404235
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHG

SEQ ID NO: 9754 - protein, 1214 aa, Homo sapiens
  Payload ID: 1976;
  Gene Symbol: BRPF1;
  Gene Name: bromodomain and PHD finger containing, 1;
  Uniprot ID:  P55201;
  ENSP ID: ENSP00000410210
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVEVDLHGRVHRISIFDNLDVVSEDEEAPEEAPENGSNKENTETPAATPKSGKHKNKEKRKDSNHHHHHNVSASTTPKLPEVVYRELEQDTPDAPPRPTSYYRYIEKSAEELDEEVEYDMDEEDYIWLDIMNERRKTEGVSPIPQEIFEYLMDRLEKESYFESHNKGDPNALVDEDAVCCICNDGECQNSNVILFCDMCNLAVHQECYGVPYIPEGQWLCRRCLQSPSRAVDCALCPNKGGAFKQTDDGRWAHVVCALWIPEVCFANTVFLEPIDSIEHIPPARWKLTCYICKQRGSGACIQCHKANCYTAFHVTCAQQAGLYMKMEPVRETGANGTSFSVRKTAYCDIHTPPGSARRLPALSHSEGEEDEDEEEDEGKGWSSEKVKKAKAKSRIKMKKARKILAEKRAAAPVVSVPCIPPHRLSKITNRLTIQRKSQFMQRLHSYWTLKRQSRNGVPLLRRLQTHLQSQRNCDQVGRDSEDKNWALKEQLKSWQRLRHDLERARLLVELIRKREKLKRETIKVQQIAMEMQLTPFLILLRKTLEQLQEKDTGNIFSEPVPLSEVPDYLDHIKKPMDFFTMKQNLEAYRYLNFDDFEEDFNLIVSNCLKYNAKDTIFYRAAVRLREQGGAVLRQARRQAEKMGIDFETGMHIPHSLAGDEATHHTEDAAEEERLVLLENQKHLPVEEQLKLLLERLDEVNASKQSVGRSRRAKMIKKEMTALRRKLAHQRETGRDGPERHGPSSRGSLTPHPAACDKDGQTDSAAEESSSQETSKGLGPNMSSTPAHEVGRRTSVLFSKKNPKTAGPPKRPGRPPKNRESQMTPSHGGSPVGPPQLPIMSSLRQRKRGRSPRPSSSSDSDSDKSTEDPPMDLPANGFSGGNQPVKKSFLVYRNDCSLPRSSSDSESSSSSSSSAASDRTSTTPSKQGRGKPSFSRGTFPEDSSEDTSGTENEAYSVGTGRGVGHSMVRKSLGRGAGWLSEDEDSPLDALDLVWAKCRGYPSYPALIIDPKMPREGMFHHGVPIPVPPLEVLKLGEQMTQEAREHLYLVLFFDNKRTWQWLPRTKLVPLGVNQDLDKEKMLEGRKSNIRKSVQIAYHRALQHRSKVQGEQSSETSDSD

SEQ ID NO: 9755 - protein, 100 aa, Homo sapiens
  Payload ID: 1976;
  Gene Symbol: BRPF1;
  Gene Name: bromodomain and PHD finger containing, 1;
  ENSP ID: ENSP00000416728
MGVDFDVKTFCHNLRATKPPYECPVETCRKVYKSYSGIEYHLYHYDHDNPPPPQQTPLRKHKKKGRQSRPANKQSPSPSEVSQSPGREVMSYAQAQRMVE

SEQ ID NO: 9756 - protein, 935 aa, Homo sapiens
  Payload ID: 1977;
  Gene Symbol: BRPF3;
  Gene Name: bromodomain and PHD finger containing, 3;
  Uniprot ID:  Q9ULD4;
  ENSP ID: ENSP00000345419
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDGMTNGFGKHTESGSDSECSLGLSGGLAFEACSGLTPPKRSRGKPALSRVPFLEGVNGDSDYNGSGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 9757 - protein, 1205 aa, Homo sapiens
  Payload ID: 1977;
  Gene Symbol: BRPF3;
  Gene Name: bromodomain and PHD finger containing, 3;
  Uniprot ID:  Q9ULD4;
  ENSP ID: ENSP00000350267
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHTESGSDSECSLGLSGGLAFEACSGLTPPKRSRGKPALSRVPFLEGVNGDSDYNGSGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 9758 - protein, 95 aa, Homo sapiens
  Payload ID: 1977;
  Gene Symbol: BRPF3;
  Gene Name: bromodomain and PHD finger containing, 3;
  ENSP ID: ENSP00000410669
MRKPRRKSRQNAEGRRSPSPYSLKCSPTRETLTYAQAQRIVEVDIDGRLHRISIYDPLKIITEDELTAQDITECNSNKENSEQPQFPGKSKKPSS

SEQ ID NO: 9759 - protein, 599 aa, Homo sapiens
  Payload ID: 1977;
  Gene Symbol: BRPF3;
  Gene Name: bromodomain and PHD finger containing, 3;
  ENSP ID: ENSP00000411558
  MOD_RES (1)..(1): Any amino acid
XRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVLYV

SEQ ID NO: 9760 - protein, 246 aa, Homo sapiens
  Payload ID: 1977;
  Gene Symbol: BRPF3;
  Gene Name: bromodomain and PHD finger containing, 3;
  ENSP ID: ENSP00000413022
  MOD_RES (1)..(1): Any amino acid
XPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHTESGSDSECSLGLSGGLAFEACRQKPPAAL

SEQ ID NO: 9761 - protein, 129 aa, Homo sapiens
  Payload ID: 1977;
  Gene Symbol: BRPF3;
  Gene Name: bromodomain and PHD finger containing, 3;
  ENSP ID: ENSP00000413655
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPE

SEQ ID NO: 9762 - protein, 821 aa, Homo sapiens
  Payload ID: 1977;
  Gene Symbol: BRPF3;
  Gene Name: bromodomain and PHD finger containing, 3;
  ENSP ID: ENSP00000416842
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDGMTNGFGKHTESGSDSECSLGLSGGLAFEACSGLTPPKRSRGKPALSRVPFLEGVNGDSDYNGSEASCCPLKTAETWSPWSWCGPSAEATPPTLP

SEQ ID NO: 9763 - protein, 93 aa, Homo sapiens
  Payload ID: 1977;
  Gene Symbol: BRPF3;
  Gene Name: bromodomain and PHD finger containing, 3;
  ENSP ID: ENSP00000431894
MNQVWIGCTGCNLGCPLTLSFTSVCLYSRLNKICSGLSFQRKNQFMQRLHNYWLLKRQARNGVPLIRRLHSHLQSQRNAEQREQDEKTSAVKE

SEQ ID NO: 9764 - protein, 871 aa, Homo sapiens
  Payload ID: 1977;
  Gene Symbol: BRPF3;
  Gene Name: bromodomain and PHD finger containing, 3;
  Uniprot ID:  Q9ULD4;
  ENSP ID: ENSP00000434501
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDGRSLLLPFEDRGDLEPLELVWAKCRGYPSYPALIIDPKMPREGLLHNGVPIPVPPLDVLKLGEQKQAEAGEKLFLVLFFDNKRTWQWLPRDKVLPLGVEDTVDKLKMLEGRKTSIRKSVQVAYDRAMIHLSRVRGPHSFVTSSYL

SEQ ID NO: 9765 - protein, 1106 aa, Homo sapiens
  Payload ID: 1977;
  Gene Symbol: BRPF3;
  Gene Name: bromodomain and PHD finger containing, 3;
  ENSP ID: ENSP00000436504
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVPDYLEFISKPMDFSTMRRKLESHLYRTLEEFEEDFNLIVTNCMKYNAKDTIFHRAAVRLRDLGGAILRHARRQAENIGYDPERGTHLPESPKLEDFYRFSWEDVDNILIPENRAHLSPEVQLKELLEKLDLVSAMRSSGARTRRVRLLRREINALRQKLAQPPPPQPPSLNKTVSNGELPAGPQGDAAVLEQALQEEPEDDGDRDDSKLPPPPTLEPTGPAPSLSEQESPPEPPTLKPINDSKPPSRFLKPRKVEEDELLEKSPLQLGNEPLQRLLSDNGINRLSLMAPDTPAGTPLSGVGRRTSVLFKKAKNGVKLQRSPDRVLENGEDHGVAGSPASPASIEEERHSRKRPRSRSCSESEGERSPQQEEETGMTNGFGKHTESGSDSECSLGLSGGLAFEACSGLTPPKRSRGKPALSRVPFLEGVNGDSDYNGSDHRSQDAPGGPPAQWRSHPCPPAGRAEAGRAETGRGWREALPCPLL

SEQ ID NO: 9766 - protein, 626 aa, Homo sapiens
  Payload ID: 1977;
  Gene Symbol: BRPF3;
  Gene Name: bromodomain and PHD finger containing, 3;
  ENSP ID: ENSP00000437087
MRKPRRKSRQNAEGRRSPSPYSLKCSPTRETLTYAQAQRIVEVDIDGRLHRISIYDPLKIITEDELTAQDITECNSNKENSEQPQFPGKSKKPSSKGKKKESCSKHASGTSFHLPQPSFRMVDSGIQPEAPPLPAAYYRYIEKPPEDLDAEVEYDMDEEDLAWLDMVNEKRRVDGHSLVSADTFELLVDRLEKESYLESRSSGAQQSLIDEDAFCCVCLDDECHNSNVILFCDICNLAVHQECYGVPYIPEGQWLCRCCLQSPSRPVDCILCPNKGGAFKQTSDGHWAHVVCAIWIPEVCFANTVFLEPIEGIDNIPPARWKLTCYICKQKGLGAAIQCHKVNCYTAFHVTCAQRAGLFMKIEPMRETSLNGTIFTVRKTAYCEAHSPPGAATARRKGDSPRSISETGDEEGLKEGDGEEEEEEEVEEEEQEAQGGVSGSLKGVPKKSKMSLKQKIKKEPEEAGQDTPSTLPMLAVPQIPSYRLNKICSGLSFQRKNQFMQRLHNYWLLKRQARNGVPLIRRLHSHLQSQRNAEQREQDEKTSAVKEELKYWQKLRHDLERARLLIELIRKREKLKREQVKVQQAAMELELMPFNVLLRTTLDLLQEKDPAHIFAEPVNLSEVLYV

SEQ ID NO: 9767 - protein, 2320 aa, Homo sapiens
  Payload ID: 1978;
  Gene Symbol: BRWD1;
  Gene Name: bromodomain and WD repeat domain containing 1;
  Uniprot ID:  Q9NSI6;
  ENSP ID: ENSP00000330753
MAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRVHDGKKSIRATNYVESNWKKQCKELVNLIFQCEDSEPFRQPVDLVEYPDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSERRKRNRPITNGSTLSESEVEDSLATSLSSSASSSSEESKESSRARESSSRSGLSRSSNLRVTRTRAAQRKTGPVSLANGCGRKATRKRVYLSDSDNNSLETGEILKARAGNNRKVLRKCAAVAANKIKLMSDVEENSSSESVCSGRKLPHRNASAVARKKLLHNSEDEQSLKSEIEEEELKDENQLLPVSSSHTAQSNVDESENRDSESESDLRVARKNWHANGYKSHTPAPSKTKFLKIESSEEDSKSHDSDHACNRTAGPSTSVQKLKAESISEEADSEPGRSGGRKYNTFHKNASFFKKTKILSDSEDSESEEQDREDGKCHKMEMNPISGNLNCDPIAMSQCSSDHGCETDLDSDDDKIEKPNNFMKDSASQDNGLSRKISRKRVCSSDSDSSLQVVKKSSKARTGLLRITRRCAATAANKIKLMSDVEDVSLENVHTRSKNGRKKPLHLACTTAKKKLSDCEGSVHCEVPSEQYACEGKPPDPDSEGSTKVLSQALNGDSDSEDMLNSEHKHRHTNIHKIDAPSKRKSSSVTSSGEDSKSHIPGSETDRTFSSESTLAQKATAENNFEVELNYGLRRWNGRRLRTYGKAPFSKTKVIHDSQETAEKEVKRKRSHPELENVKISETTGNSKFRPDTSSKSSDLGSVTESDIDCTDNTKTKRRKTKGKAKVVRKEFVPRDREPNTKVRTCMHNQKDAVQMPSETLKAKMVPEKVPRRCATVAANKIKIMSNLKETISGPENVWIRKSSRKLPHRNASAAAKKKLLNVYKEDDTTINSESEKELEDINRKMLFLRGFRSWKENAQ

SEQ ID NO: 9768 - protein, 120 aa, Homo sapiens
  Payload ID: 1978;
  Gene Symbol: BRWD1;
  Gene Name: bromodomain and WD repeat domain containing 1;
  Uniprot ID:  Q9NSI6;
  ENSP ID: ENSP00000342106
MAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKGTLI

SEQ ID NO: 9769 - protein, 2269 aa, Homo sapiens
  Payload ID: 1978;
  Gene Symbol: BRWD1;
  Gene Name: bromodomain and WD repeat domain containing 1;
  Uniprot ID:  Q9NSI6;
  ENSP ID: ENSP00000344333
MAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRVHDGKKSIRATNYVESNWKKQCKELVNLIFQCEDSEPFRQPVDLVEYPDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSERRKRNRPITNGSTLSESEVEDSLATSLSSSASSSSEESKESSRARESSSRSGLSRSSNLRVTRTRAAQRKTGPVSLANGCGRKATRKRVYLSDSDNNSLETGEILKARAGNNRKVLRKCAAVAANKIKLMSDVEENSSSESVCSGRKLPHRNASAVARKKLLHNSEDEQSLKSEIEEEELKDENQLLPVSSSHTAQSNVDESENRDSESESDLRVARKNWHANGYKSHTPAPSKTKFLKIESSEEDSKSHDSDHACNRTAGPSTSVQKLKAESISEEADSEPGRSGGRKYNTFHKNASFFKKTKILSDSEDSESEEQDREDGKCHKMEMNPISGNLNCDPIAMSQCSSDHGCETDLDSDDDKIEKPNNFMKDSASQDNGLSRKISRKRVCSSDSDSSLQVVKKSSKARTGLLRITRRCAATAANKIKLMSDVEDVSLENVHTRSKNGRKKPLHLACTTAKKKLSDCEGSVHCEVPSEQYACEGKPPDPDSEGSTKVLSQALNGDSDSEDMLNSEHKHRHTNIHKIDAPSKRKSSSVTSSGEDSKSHIPGSETDRTFSSESTLAQKATAENNFEVELNYGLRRWNGRRLRTYGKAPFSKTKVIHDSQETAEKEVKRKRSHPELENVKISETTGNSKFRPDTSSKSSDLGSVTESDIDCTDNTKTKRRKTKGKAKVVRKGKTFTANISKTVRRQRQSKRPRLSVDDNDWEDLDYAKSKRVLRRSKIKTRNQGRRTVRYHDGDDDRSLENVLDFNGCTL

SEQ ID NO: 9770 - protein, 2199 aa, Homo sapiens
  Payload ID: 1978;
  Gene Symbol: BRWD1;
  Gene Name: bromodomain and WD repeat domain containing 1;
  Uniprot ID:  Q9NSI6;
  ENSP ID: ENSP00000370178
MAEPSSARRPVPLIESELYFLIARYLSAGPCRRAAQVLVQELEQYQLLPKRLDWEGNEHNRSYEELVLSNKHVAPDHLLQICQRIGPMLDKEIPPSISRVTSLLGAGRQSLLRTAKDCRHTVWKGSAFAALHRGRPPEMPVNYGSPPNLVEIHRGKQLTGCSTFSTAFPGTMYQHIKMHRRILGHLSAVYCVAFDRTGHRIFTGSDDCLVKIWSTHNGRLLSTLRGHSAEISDMAVNYENTMIAAGSCDKIIRVWCLRTCAPVAVLQGHTGSITSLQFSPMAKGSQRYMVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRVHDGKKSIRATNYVESNWKKQCKELVNLIFQCEDSEPFRQPVDLVEYPDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSERRKRNRPITNGSTLSESEVEDSLATSLSSSASSSSEESKESSRARESSSRSGLSRSSNLRVTRTRAAQRKTGPVSLANGCGRKATRKRVYLSDSDNNSLETGEILKARAGNNRKVLRKCAAVAANKIKLMSDVEENSSSESVCSGRKLPHRNASAVARKKLLHNSEDEQSLKSEIEEEELKDENQLLPVSSSHTAQSNVDESENRDSESESDLRVARKNWHANGYKSHTPAPSKTKFLKIESSEEDSKSHDSDHACNRTAGPSTSVQKLKAESISEEADSEPGRSGGRKYNTFHKNASFFKKTKILSDSEDSESEEQDREDGKCHKMEMNPISGNLNCDPIAMSQCSSDHGCETDLDSDDDKIEKPNNFMKDSASQDNGLSRKISRKRVCSSDSDSSLQVVKKSSKARTGLLRITRRCAATAANKIKLMSDVEDVSLENVHTRSKNGRKKPLHLACTTAKKKLSDCEGSVHCEVPSEQYACEGKPPDPDSEGSTKVLSQALNGDSDSEDMLNSEHKHRHTNIHKIDAPSKRKSSSVTSSGEDSKSHIPGSETDRTFSSESTLAQKATAENNFEVELNYGLRRWNGRRLRTYGKAPFSKTKVIHDSQETAEKEVKRKRSHPELENVKISETTGNSKFRPDTSSKSSDLGSVTESDIDCTDNTKTKRRKTKGKAKVVRKDKTFSPVYL

SEQ ID NO: 9771 - protein, 548 aa, Homo sapiens
  Payload ID: 1978;
  Gene Symbol: BRWD1;
  Gene Name: bromodomain and WD repeat domain containing 1;
  ENSP ID: ENSP00000389882
  MOD_RES (1)..(1): Any amino acid
XVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKETSCDQSEGSGSSEEDEWRSDRKSESYSESSSDSSSRYSDWTADAGINLQPPL

SEQ ID NO: 9772 - protein, 235 aa, Homo sapiens
  Payload ID: 1978;
  Gene Symbol: BRWD1;
  Gene Name: bromodomain and WD repeat domain containing 1;
  ENSP ID: ENSP00000390684
  MOD_RES (1)..(1): Any amino acid
XVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDYS

SEQ ID NO: 9773 - protein, 640 aa, Homo sapiens
  Payload ID: 1978;
  Gene Symbol: BRWD1;
  Gene Name: bromodomain and WD repeat domain containing 1;
  ENSP ID: ENSP00000391014
HGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEVPLGIFRKLEDFRLEKGEEERNLYIIGRKRKTLQLSHKSDSVVLVSQSRQRTCRRKYPNYGRRNRSWRELSSGNESSSSVRHETSCDQSEGSGSSEEDEWRSDRKSESYSESSSDSSSRYSDWTADAGINLQPPLRTSCRRRITRFCSSSEDEISTENLSPPKRRRKRKKENKPKKENLRRMTPAELANMEHLYEFHPPVWITDTTLRKSPFVPQMGDEVIYFRQGHEAYIEAVRRNNIYELNPNKEPWRKMDLRDQELVKIVGIRYEVGPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGGCLR

SEQ ID NO: 9774 - protein, 266 aa, Homo sapiens
  Payload ID: 1978;
  Gene Symbol: BRWD1;
  Gene Name: bromodomain and WD repeat domain containing 1;
  ENSP ID: ENSP00000393702
  MOD_RES (1)..(1): Any amino acid
XVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKM

SEQ ID NO: 9775 - protein, 409 aa, Homo sapiens
  Payload ID: 1978;
  Gene Symbol: BRWD1;
  Gene Name: bromodomain and WD repeat domain containing 1;
  ENSP ID: ENSP00000395575
  MOD_RES (1)..(1): Any amino acid
XVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGSWKTSD

SEQ ID NO: 9776 - protein, 467 aa, Homo sapiens
  Payload ID: 1978;
  Gene Symbol: BRWD1;
  Gene Name: bromodomain and WD repeat domain containing 1;
  ENSP ID: ENSP00000398900
  MOD_RES (1)..(1): Any amino acid
XVSTGADGTVCFWQWDLESLKFSPRPLKFTEKPRPGVQMLCSSFSVGGMFLATGSTDHVIRMYFLGFEAPEKIAELESHTDKVDSIQFCNNGDRFLSGSRDGTARIWRFEQLEWRSILLDMATRISGDLSSEEERFMKPKVTMIAWNQNDSIVVTAVNDHVLKVWNSYTGQLLHNLMGHADEVFVLETHPFDSRIMLSAGHDGSIFIWDITKGTKMKHYFNMIEGQGHGAVFDCKFSQDGQHFACTDSHGHLLIFGFGCSKPYEKIPDQMFFHTDYRPLIRDSNNYVLDEQTQQAPHLMPPPFLVDVDGNPHPTKYQRLVPGRENSADEHLIPQLGYVATSDGEVIEQIISLQTNDNDERSPESSILDGMIRQLQQQQDQRMGADQDTIPRGLSNGEETPRRGFRRLSLDIQSPPNIGLRRSGQVEGVRQMHQNAPRSQIATERDLQAWKRRVVVPEEAGRLPIRER

SEQ ID NO: 9777 - protein, 452 aa, Homo sapiens
  Payload ID: 1978;
  Gene Symbol: BRWD1;
  Gene Name: bromodomain and WD repeat domain containing 1;
  ENSP ID: ENSP00000415066
  MOD_RES (1)..(1): Any amino acid
XPPTLCCLKLAFIDPATGKLMDKSFSIRYHDMPDVIDFLVLRQFYDEARQRNWQSCDRFRSIIDDAWWFGTVLSQEPYQPQYPDSHFQCYIVRWDNTEIEKLSPWDMEPIPDNVDPPEELGASISVTTDELEKLLYKPQAGEWGQKSRDEECDRIISGIDQLLNLDIAAAFAGPVDLCTYPKYCTVVAYPTDLYTIRMRLVNRFYRRLSALVWEVRYIEHNARTFNEPESVIARSAKKITDQLLKFIKNQHCTNISELSNTSENDEQNAEDLDDSDLPKTSSGRRRDYRDIIDTPMDFGTVRETLDAGNYDSPLEFCKDIRLIFSNAKAYTPNKRSKIYSMTLRLSALFEEKMKKISSDFKIGQKFNEKLRRSQRFKQRQNCKGDSQPNKSIRNLKPKRLKSQTKIIPELVGSPTQSTSSRTAYLGTHKTSAGISSGVTSGDSSDSAESSER

SEQ ID NO: 9778 - protein, 1802 aa, Homo sapiens
  Payload ID: 1979;
  Gene Symbol: BRWD3;
  Gene Name: bromodomain and WD repeat domain containing 3;
  Uniprot ID:  Q6RI45;
  ENSP ID: ENSP00000362372
MAAAPTQIEAELYYLIARFLQSGPCNKSAQVLVQELEEHQLIPRRLDWEGKEHRRSFEDLVAANAHIPPDYLLKICERIGPLLDKEIPQSVPGVQTLLGVGRQSLLRDAKDCKSTLWNGSAFAALHRGRPPELPVNYVKPPNVVNITSARQLTGCSRFGHIFPSSAYQHIKMHKRILGHLSSVYCVAFDRSGRRIFTGSDDCLVKIWATDDGRLLATLRGHSAEISDMAVNYENTLIAAGSCDKVVRVWCLRTCAPVAVLQGHSASITSIQFCPSTKGTNRYLTSTGADGTICFWQWHVKTMKFRDRPVKFTERSRPGVQISCSSFSSGGMFITTGSTDHVIRIYYLGSEVPEKIAELESHTDKVVAVQFCNNGDSLRFVSGSRDGTARIWQYQQQEWKSIVLDMATKMTGNNLPSGEDKITKLKVTMVAWDRYDTTVITAVNNFLLKVWNSITGQLLHTLSGHDDEVFVLEAHPFDQRIILSAGHDGNIFIWDLDRGTKIRNYFNMIEGQGHGAVFDCKFSPDGNHFACTDSHGHLLLFGFGCSKYYEKIPDQMFFHTDYRPLIRDANNYVLDEQTQQAPHLMPPPFLVDVDGNPHPTKFQRLVPGRENCKDEQLIPQLGYVANGDGEVVEQVIGQQTNDQDESILDGIIRELQREQDLRLINEGDVPHLPVNRAYSVNGALRSPNMDISSSPNIRLRRHSSQIEGVRQMHNNAPRSQMATERDLMAWSRRVVVNELNNGVSRVQEECRTAKGDIEISLYTVEKKKKPSYTTQRNDYEPSCGRSLRRTQRKRQHTYQTRSNIEHNSQASCQNSGVQEDSDSSSEEDETVGTSDASVEDPVVEWQSESSSSDSSSEYSDWTADAGINLQPPKRQTRQTTRKICSSSDEENLKSLEERQKKPKQTRKKKGGLVSIAGEPNEEWFAPQWILDTIPRRSPFVPQMGDELIYFRQGHEAYVRAVRKSKIYSVNLQKQPWNKMDLREQEFVKIVGIKYEVGPPTLCCLKLAFLDPISGKMTGESFSIKYHDMPDVIDFLVLHQFYNEAKERNWQIGDRFRSIIDDAWWFGTVESQQPFQPEYPDSSFQCYSVHWDNNEREKMSPWDMEPIPEGTAFPDEVGAGVPVSQEELTALLYKPQEGEWGAHSRDEECERVIQGINHLLSLDFASPFAVPVDLSAYPLYCTVVAYPTDLNTIRRRLENRFYRRISALMWEVRYIEHNARTFNEPDSPIVKAAKIVTDVLLRFIGDQSCTDILDTYNKIKAEERNSTDAEEDTEIVDLDSDGPGTSSGRKVKCRGRRQSLKCNPDAWKKQCKELLSLIYEREDSEPFRQPADLLSYPGHQEQEGESSESVVPERQQDSSLSEDYQDVIDTPVDFSTVKETLEAGNYGSPLEFYKDVRQIFNNSKAYTSNKKSRIYSMMLRLSALFESHIKNIISEYKSAIQSQKRRRPRYRKRLRSSSSSLSSSGAPSPKGKQKQMKLQPKNDQNTSVSHARTSSPFSSPVSDAAEGLSLYLLDDEPDGPFSSSSFGGYSRSGNSHDPGKAKSFRNRVLPVKQDHSLDGPLTNGDGREPRTGIKRKLLSASEEDENMGGEDKEKKETKEKSHLSTSESGELGSSLSSESTCGSDSDSESTSRTDQDYVDGDHDYSKFIQTRPKRKLRKQHGNGKRNWKTRGTGGRGRWGRWGRWSRGGRGRGGRGRGSRGRGGGGTRGRGRGRGGRGASRGATRAKRARIADDEFDTMFSGRFSRLPRIKTRNQGRRTVLYNDDSDNDNFVSTEDPLNLGTSRSGRVRKMTEKARVSHLMGWNY

SEQ ID NO: 9779 - protein, 1058 aa, Homo sapiens
  Payload ID: 1980;
  Gene Symbol: BRD1;
  Gene Name: bromodomain containing 1;
  Uniprot ID:  O95696;
  ENSP ID: ENSP00000216267
MRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 9780 - protein, 1058 aa, Homo sapiens; identical to SEQ ID NO: 9779
  Payload ID: 1980;
  Gene Symbol: BRD1;
  Gene Name: bromodomain containing 1;
  Uniprot ID:  O95696;
  ENSP ID: ENSP00000384076

SEQ ID NO: 9781 - protein, 1189 aa, Homo sapiens
  Payload ID: 1980;
  Gene Symbol: BRD1;
  Gene Name: bromodomain containing 1;
  Uniprot ID:  O95696;
  ENSP ID: ENSP00000385858
MRRKGRCHRGSAARHPSSPCSVKHSPTRETLTYAQAQRMVEIEIEGRLHRISIFDPLEIILEDDLTAQEMSECNSNKENSERPPVCLRTKRHKNNRVKKKNEALPSAHGTPASASALPEPKVRIVEYSPPSAPRRPPVYYKFIEKSAEELDNEVEYDMDEEDYAWLEIVNEKRKGDCVPAVSQSMFEFLMDRFEKESHCENQKQGEQQSLIDEDAVCCICMDGECQNSNVILFCDMCNLAVHQECYGVPYIPEGQWLCRHCLQSRARPADCVLCPNKGGAFKKTDDDRWGHVVCALWIPEVGFANTVFIEPIDGVRNIPPARWKLTCYLCKQKGVGACIQCHKANCYTAFHVTCAQKAGLYMKMEPVKELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEGDKSPPKLEPSDALPLPSNSETNSEPPTLKPVELNPEQSKLFKRVTFDNESHSACTQSALVSGRPPEPTRASSGDVPAAAASAVAEPASDVNRRTSVLFCKSKSVSPPKSAKNTETQPTSPQLGTKTFLSVVLPRLETLLQPRKRSRSTCGDSEVEEESPGKRLDAGLTNGFGGARSEQEPGGGLGRKATPRRRCASESSISSSNSPLCDSSFNAPKCGRGKPALVRRHTLEDRSELISCIENGNYAKAARIAAEVGQSSMWISTDAAASVLEPLKVVWAKCSGYPSYPALIIDPKMPRVPGHHNGVTIPAPPLDVLKIGEHMQTKSDEKLFLVLFFDNKRSWQWLPKSKMVPLGIDETIDKLKMMEGRNSSIRKAVRIAFDRAMNHLSRVHGEPTSDLSDID

SEQ ID NO: 9782 - protein, 509 aa, Homo sapiens
  Payload ID: 1980;
  Gene Symbol: BRD1;
  Gene Name: bromodomain containing 1;
  ENSP ID: ENSP00000388027
ELTGGGTTFSVRKTAYCDVHTPPGCTRRPLNIYGDVEMKNGVCRKESSVKTVRSTSKVRKKAKKAKKALAEPCAVLPTVCAPYIPPQRLNRIANQVAIQRKKQFVERAHSYWLLKRLSRNGAPLLRRLQSSLQSQRSSQQRENDEEMKAAKEKLKYWQRLRHDLERARLLIELLRKREKLKREQVKVEQVAMELRLTPLTVLLRSVLDQLQDKDPARIFAQPVSLKEVPDYLDHIKHPMDFATMRKRLEAQGYKNLHEFEEDFDLIIDNCMKYNARDTVFYRAAVRLRDQGGVVLRQARREVDSIGLEEASGMHLPERPAAAPRRPFSWEDVDRLLDPANRAHLGLEEQLRELLDMLDLTCAMKSSGSRSKRAKLLKKEIALLRNKLSQQHSQPLPTGPGLEGFEEDGAALGPEAGEEARDQNLFVCSPSEVGDSSAAKEKVAEHMRRLRGGGGVPRKAPGRRSHQRLWGCEERAGAGRRPGEEGHTPTTLCLRVQHLLQQQPALRLEL

SEQ ID NO: 9783 - protein, 1189 aa, Homo sapiens; identical to SEQ ID NO: 9781
  Payload ID: 1980;
  Gene Symbol: BRD1;
  Gene Name: bromodomain containing 1;
  Uniprot ID:  O95696;
  ENSP ID: ENSP00000410042

SEQ ID NO: 9784 - protein, 801 aa, Homo sapiens
  Payload ID: 1981;
  Gene Symbol: BRD2;
  Gene Name: bromodomain containing 2;
  Uniprot ID:  P25440;
  ENSP ID: ENSP00000363958
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 9785 - protein, 801 aa, Homo sapiens; identical to SEQ ID NO: 9784
  Payload ID: 1981;
  Gene Symbol: BRD2;
  Gene Name: bromodomain containing 2;
  Uniprot ID:  P25440;
  ENSP ID: ENSP00000363964

SEQ ID NO: 9786 - protein, 801 aa, Homo sapiens; identical to SEQ ID NO: 9784
  Payload ID: 1981;
  Gene Symbol: BRD2;
  Gene Name: bromodomain containing 2;
  Uniprot ID:  P25440;
  ENSP ID: ENSP00000372588

SEQ ID NO: 9787 - protein, 836 aa, Homo sapiens
  Payload ID: 1981;
  Gene Symbol: BRD2;
  Gene Name: bromodomain containing 2;
  Uniprot ID:  P25440;
  ENSP ID: ENSP00000378702
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQDYRLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 9788 - protein, 836 aa, Homo sapiens; identical to SEQ ID NO: 9787
  Payload ID: 1981;
  Gene Symbol: BRD2;
  Gene Name: bromodomain containing 2;
  Uniprot ID:  P25440;
  ENSP ID: ENSP00000382443

SEQ ID NO: 9789 - protein, 801 aa, Homo sapiens; identical to SEQ ID NO: 9784
  Payload ID: 1981;
  Gene Symbol: BRD2;
  Gene Name: bromodomain containing 2;
  Uniprot ID:  P25440;
  ENSP ID: ENSP00000382444

SEQ ID NO: 9790 - protein, 801 aa, Homo sapiens; identical to SEQ ID NO: 9784
  Payload ID: 1981;
  Gene Symbol: BRD2;
  Gene Name: bromodomain containing 2;
  Uniprot ID:  P25440;
  ENSP ID: ENSP00000382445

SEQ ID NO: 9791 - protein, 613 aa, Homo sapiens
  Payload ID: 1981;
  Gene Symbol: BRD2;
  Gene Name: bromodomain containing 2;
  ENSP ID: ENSP00000390267
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGT

SEQ ID NO: 9792 - protein, 328 aa, Homo sapiens
  Payload ID: 1981;
  Gene Symbol: BRD2;
  Gene Name: bromodomain containing 2;
  ENSP ID: ENSP00000391113
  MOD_RES (1)..(1): Any amino acid
XAKSSSESSSEESSSESSSEEEEEEDEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 9793 - protein, 801 aa, Homo sapiens [sequence omitted]

SEQ ID NO: 9794 - protein, 296 aa, Homo sapiens
  Payload ID: 1981;
  Gene Symbol: BRD2;
  Gene Name: bromodomain containing 2;
  ENSP ID: ENSP00000391758
  MOD_RES (1)..(1): Any amino acid
XRPLGVQQPGARLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAIL

SEQ ID NO: 9795 - protein, 328 aa, Homo sapiens; identical to SEQ ID NO: 9792
  Payload ID: 1981;
  Gene Symbol: BRD2;
  Gene Name: bromodomain containing 2;
  ENSP ID: ENSP00000393706
  MOD_RES (1)..(1): Any amino acid

SEQ ID NO: 9796 - protein, 801 aa, Homo sapiens [sequence omitted]

SEQ ID NO: 9797 - protein, 613 aa, Homo sapiens; identical to SEQ ID NO: 9791
  Payload ID: 1981;
  Gene Symbol: BRD2;
  Gene Name: bromodomain containing 2;
  ENSP ID: ENSP00000400369

SEQ ID NO: 9798 - protein, 807 aa, Homo sapiens
  Payload ID: 1981;
  Gene Symbol: BRD2;
  Gene Name: bromodomain containing 2;
  ENSP ID: ENSP00000400737
  MOD_RES (1)..(1): Any amino acid
XNGGGGSATARGGEYRLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVFNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 9799 - protein, 801 aa, Homo sapiens; identical to SEQ ID NO: 9784
  Payload ID: 1981;
  Gene Symbol: BRD2;
  Gene Name: bromodomain containing 2;
  Uniprot ID:  P25440;
  ENSP ID: ENSP00000401791

SEQ ID NO: 9800 - protein, 619 aa, Homo sapiens
  Payload ID: 1981;
  Gene Symbol: BRD2;
  Gene Name: bromodomain containing 2;
  ENSP ID: ENSP00000402220
  MOD_RES (1)..(1): Any amino acid
XNGGGGSATARGGEYRLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGT

SEQ ID NO: 9801 - protein, 363 aa, Homo sapiens
  Payload ID: 1981;
  Gene Symbol: BRD2;
  Gene Name: bromodomain containing 2;
  ENSP ID: ENSP00000403393
  MOD_RES (1)..(1): Any amino acid
XAKSSSESSSEESSSESSSEEEEEEDEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQDYRLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 9802 - protein, 807 aa, Homo sapiens
  Payload ID: 1981;
  Gene Symbol: BRD2;
  Gene Name: bromodomain containing 2;
  ENSP ID: ENSP00000404221
  MOD_RES (1)..(1): Any amino acid
XNGGGGSATARGGEYRLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 9803 - protein, 296 aa, Homo sapiens; identical to SEQ ID NO: 9794
  Payload ID: 1981;
  Gene Symbol: BRD2;
  Gene Name: bromodomain containing 2;
  ENSP ID: ENSP00000405050
  MOD_RES (1)..(1): Any amino acid

SEQ ID NO: 9804 - protein, 754 aa, Homo sapiens
  Payload ID: 1981;
  Gene Symbol: BRD2;
  Gene Name: bromodomain containing 2;
  Uniprot ID:  P25440;
  ENSP ID: ENSP00000405634
MASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 9805 - protein, 296 aa, Homo sapiens; identical to SEQ ID NO: 9794
  Payload ID: 1981;
  Gene Symbol: BRD2;
  Gene Name: bromodomain containing 2;
  ENSP ID: ENSP00000405661
  MOD_RES (1)..(1): Any amino acid

SEQ ID NO: 9806 - protein, 807 aa, Homo sapiens; identical to SEQ ID NO: 9802
  Payload ID: 1981;
  Gene Symbol: BRD2;
  Gene Name: bromodomain containing 2;
  ENSP ID: ENSP00000406118
  MOD_RES (1)..(1): Any amino acid

SEQ ID NO: 9807 - protein, 754 aa, Homo sapiens; identical to SEQ ID NO: 9804
  Payload ID: 1981;
  Gene Symbol: BRD2;
  Gene Name: bromodomain containing 2;
  Uniprot ID:  P25440;
  ENSP ID: ENSP00000409145

SEQ ID NO: 9808 - protein, 807 aa, Homo sapiens; identical to SEQ ID NO: 9802
  Payload ID: 1981;
  Gene Symbol: BRD2;
  Gene Name: bromodomain containing 2;
  ENSP ID: ENSP00000409613
  MOD_RES (1)..(1): Any amino acid

SEQ ID NO: 9809 - protein, 836 aa, Homo sapiens; identical to SEQ ID NO: 9787
  Payload ID: 1981;
  Gene Symbol: BRD2;
  Gene Name: bromodomain containing 2;
  Uniprot ID:  P25440;
  ENSP ID: ENSP00000410994

SEQ ID NO: 9810 - protein, 296 aa, Homo sapiens; identical to SEQ ID NO: 9794
  Payload ID: 1981;
  Gene Symbol: BRD2;
  Gene Name: bromodomain containing 2;
  ENSP ID: ENSP00000411074
  MOD_RES (1)..(1): Any amino acid

SEQ ID NO: 9811 - protein, 296 aa, Homo sapiens; identical to SEQ ID NO: 9794
  Payload ID: 1981;
  Gene Symbol: BRD2;
  Gene Name: bromodomain containing 2;
  ENSP ID: ENSP00000411195
  MOD_RES (1)..(1): Any amino acid

SEQ ID NO: 9812 - protein, 836 aa, Homo sapiens; identical to SEQ ID NO: 9787
  Payload ID: 1981;
  Gene Symbol: BRD2;
  Gene Name: bromodomain containing 2;
  Uniprot ID:  P25440;
  ENSP ID: ENSP00000412885

SEQ ID NO: 9813 - protein, 328 aa, Homo sapiens; identical to SEQ ID NO: 9792
  Payload ID: 1981;
  Gene Symbol: BRD2;
  Gene Name: bromodomain containing 2;
  ENSP ID: ENSP00000413125
  MOD_RES (1)..(1): Any amino acid

SEQ ID NO: 9814 - protein, 836 aa, Homo sapiens
  Payload ID: 1981;
  Gene Symbol: BRD2;
  Gene Name: bromodomain containing 2;
  ENSP ID: ENSP00000413845
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVFNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQNYRLPKKATKTAPPALPTGYDSEEEEESRPMSYDEKRQLSLDINKLPGEKLGRVVHIIQAREPSLRDSNPEEIEIDFETLKPSTLRELERYVLSCLRKKPRKPYTIKKPVGKTKEELALEKKRELEKRLQDVSGQLNSTKKPPKKANEKTESSSAQQVAVSRLSASSSSSDSSSSSSSSSSSDTSDSDSG

SEQ ID NO: 9815 - protein, 648 aa, Homo sapiens
  Payload ID: 1981;
  Gene Symbol: BRD2;
  Gene Name: bromodomain containing 2;
  ENSP ID: ENSP00000414641
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKKEKKKKRKAEKHRGRAGADEDDKGPRAPRPPQPKKSKKASGSGGGSAALGPSGFGPSGGSGTKLQAGVQWRDLGLLQPPLLGFKRFSCLSLPSSQDY

SEQ ID NO: 9816 - protein, 296 aa, Homo sapiens
  Payload ID: 1981;
  Gene Symbol: BRD2;
  Gene Name: bromodomain containing 2;
  ENSP ID: ENSP00000416399
  MOD_RES (1)..(1): Any amino acid
XRPLGVQQPGARLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVFNIPHPSVISSPLLKSLHSAGPPLLAVTAAPPAQPLAKKKGVKRKADTTTPTPTAIL

SEQ ID NO: 9817 - protein, 328 aa, Homo sapiens; identical to SEQ ID NO: 9792
  Payload ID: 1981;
  Gene Symbol: BRD2;
  Gene Name: bromodomain containing 2;
  ENSP ID: ENSP00000428080
  MOD_RES (1)..(1): Any amino acid

SEQ ID NO: 9818 - protein, 147 aa, Homo sapiens
  Payload ID: 1981;
  Gene Symbol: BRD2;
  Gene Name: bromodomain containing 2;
  ENSP ID: ENSP00000431499
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPIPTSGWERTTVAKILSFFLSLMQPMDSQPQRIITKL

SEQ ID NO: 9819 - protein, 147 aa, Homo sapiens; identical to SEQ ID NO: 9818
  Payload ID: 1981;
  Gene Symbol: BRD2;
  Gene Name: bromodomain containing 2;
  ENSP ID: ENSP00000431514

SEQ ID NO: 9820 - protein, 137 aa, Homo sapiens
  Payload ID: 1981;
  Gene Symbol: BRD2;
  Gene Name: bromodomain containing 2;
  ENSP ID: ENSP00000432478
  MOD_RES (1)..(1): Any amino acid
XVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKLLMLPPSAAEDGEP

SEQ ID NO: 9821 - protein, 137 aa, Homo sapiens; identical to SEQ ID NO: 9820
  Payload ID: 1981;
  Gene Symbol: BRD2;
  Gene Name: bromodomain containing 2;
  ENSP ID: ENSP00000433751
  MOD_RES (1)..(1): Any amino acid

SEQ ID NO: 9822 - protein, 147 aa, Homo sapiens; identical to SEQ ID NO: 9818
  Payload ID: 1981;
  Gene Symbol: BRD2;
  Gene Name: bromodomain containing 2;
  ENSP ID: ENSP00000434155

SEQ ID NO: 9823 - protein, 147 aa, Homo sapiens; identical to SEQ ID NO: 9818
  Payload ID: 1981;
  Gene Symbol: BRD2;
  Gene Name: bromodomain containing 2;
  ENSP ID: ENSP00000434843

SEQ ID NO: 9824 - protein, 401 aa, Homo sapiens
  Payload ID: 1981;
  Gene Symbol: BRD2;
  Gene Name: bromodomain containing 2;
  ENSP ID: ENSP00000434978
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKT

SEQ ID NO: 9825 - protein, 401 aa, Homo sapiens; identical to SEQ ID NO: 9824
  Payload ID: 1981;
  Gene Symbol: BRD2;
  Gene Name: bromodomain containing 2;
  ENSP ID: ENSP00000435693

SEQ ID NO: 9826 - protein, 401 aa, Homo sapiens; identical to SEQ ID NO: 9824
  Payload ID: 1981;
  Gene Symbol: BRD2;
  Gene Name: bromodomain containing 2;
  ENSP ID: ENSP00000436322

SEQ ID NO: 9827 - protein, 147 aa, Homo sapiens; identical to SEQ ID NO: 9818
  Payload ID: 1981;
  Gene Symbol: BRD2;
  Gene Name: bromodomain containing 2;
  ENSP ID: ENSP00000437126

SEQ ID NO: 9828 - protein, 801 aa, Homo sapiens; identical to SEQ ID NO: 9784
  Payload ID: 1981;
  Gene Symbol: BRD2;
  Gene Name: bromodomain containing 2;
  Uniprot ID:  P25440;
  ENSP ID: ENSP00000449380

SEQ ID NO: 9829 - protein, 801 aa, Homo sapiens; identical to SEQ ID NO: 9784
  Payload ID: 1981;
  Gene Symbol: BRD2;
  Gene Name: bromodomain containing 2;
  Uniprot ID:  P25440;
  ENSP ID: ENSP00000449609

SEQ ID NO: 9830 - protein, 162 aa, Homo sapiens
  Payload ID: 1981;
  Gene Symbol: BRD2;
  Gene Name: bromodomain containing 2;
  ENSP ID: ENSP00000464077
MASLMPPYPLEGKGVRGRCGPPYSIRPLGVQQPGARFFAAAALPPRTTTRQASCGHTPGGFRQATPTRPLPFPCFGQWRSYEWHDLLELGSLQLGCAWKLGKTLLEGEAGRECWRLWGDGFRTSSNHPLSLESADHSSANWLGDVAGCHFPVGLCGTLLPGD

SEQ ID NO: 9831 - protein, 159 aa, Homo sapiens
  Payload ID: 1981;
  Gene Symbol: BRD2;
  Gene Name: bromodomain containing 2;
  ENSP ID: ENSP00000475288
  MOD_RES (1)..(1): Any amino acid
XPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKVPTAWGRWDAQAVMGA

SEQ ID NO: 9832 - protein, 552 aa, Homo sapiens
  Payload ID: 1981;
  Gene Symbol: BRD2;
  Gene Name: bromodomain containing 2;
  ENSP ID: ENSP00000475691
MLQNVTPHNKLPGEGNAGLLGLGPEAAAPGKRIRKPSLLYEGFESPTMASVPALQLTPANPPPPEVSNPKKPGRVTNQLQYLHKVVMKALWKHQFAWPFRQPVDAVKLGLPDYHKIIKQPMDMGTIKRRLENNYYWAASECMQDFNTMFTNCYIYNKPTDDIVLMAQTLEKIFLQKVASMPQEEQELVVTIPKNSHKKGAKLAALQGSVTSAHQVPAVSSVSHTALYTPPPEIPTTVLNIPHPSVISSPLLKSLHSAGPPLLAVTAAPPAQPLAKKKGVKRKADTTTPTPTAILAPGSPASPPGSLEPKAARLPPMRRESGRPIKPPRKDLPDSQQQHQSSKKGKLSEQLKHCNGILKELLSKKHAAYAWPFYKPVDASALGLHDYHDIIKHPMDLSTVKRKMENRDYRDAQEFAADVRLMFSNCYKYNPPDHDVVAMARKLQDVFEFRYAKMPDEPLEPGPLPVSTAMPPGLAKSSSESSSEESSSESSSEEEEEEDEEDEEEEESESSDSEEERAHRLAELQEQLRAVHEQLAALSQGPISKPKRKREKK

SEQ ID NO: 9833 - protein, 726 aa, Homo sapiens
  Payload ID: 1982;
  Gene Symbol: BRD3;
  Gene Name: bromodomain containing 3;
  Uniprot ID:  Q15059;
  ENSP ID: ENSP00000305918
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPLSDPKQAKVVARRESGGRPIKPPKKDLEDGEVPQHAGKKGKLSEHLRYCDSILREMLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKKEKEKKKKDKEKEKEKHKVKAEEEKKAKVAPPAKQAQQKKAPAKKANSTTTAGRQLKKGGKQASASYDSEEEEEGLPMSYDEKRQLSLDINRLPGEKLGRVVHIIQSREPSLRDSNPDEIEIDFETLKPTTLRELERYVKSCLQKKQRKPFSASGKKQAAKSKEELAQEKKKELEKRLQDVSGQLSSSKKPARKEKPGSAPSGGPSRLSSSSSSESGSSSSSGSSSDSSDSE

SEQ ID NO: 9834 - protein, 556 aa, Homo sapiens
  Payload ID: 1982;
  Gene Symbol: BRD3;
  Gene Name: bromodomain containing 3;
  Uniprot ID:  Q15059;
  ENSP ID: ENSP00000360900
MSTATTVAPAGIPATPGPVNPPPPEVSNPSKPGRKTNQLQYMQNVVVKTLWKHQFAWPFYQPVDAIKLNLPDYHKIIKNPMDMGTIKKRLENNYYWSASECMQDFNTMFTNCYIYNKPTDDIVLMAQALEKIFLQKVAQMPQEEVELLPPAPKGKGRKPAAGAQSAGTQQVAAVSSVSPATPFQSVPPTVSQTPVIAATPVPTITANVTSVPVPPAAAPPPPATPIVPVVPPTPPVVKKKGVKRKADTTTPTTSAITASRSESPPPLSDPKQAKVVARRESGGRPIKPPKKDLEDGEVPQHAGKKGKLSEHLRYCDSILREMLSKKHAAYAWPFYKPVDAEALELHDYHDIIKHPMDLSTVKRKMDGREYPDAQGFAADVRLMFSNCYKYNPPDHEVVAMARKLQDVFEMRFAKMPDEPVEAPALPAPAAPMVSKGAESSRSSEESSSDSGSSDSEEERATRLAELQEQLKAVHEQLAALSQAPVNKPKKKKEKKEKEKKKKDKEKEKEKHKVKAEEEKKAKVAPPAKQAQQKKAPAKKANSTTTAGRDHFLTCGV

SEQ ID NO: 9835 - protein, 74 aa, Homo sapiens
  Payload ID: 1982;
  Gene Symbol: BRD3;
  Gene Name: bromodomain containing 3;
  ENSP ID: ENSP00000360908
MSTATTVAPAGIPATPGPVNPPPPEVSNPSKPGRKTNQLQYMQNVVVKTLWKHQFAWPFYQPVDAIKLNLPDYH

SEQ ID NO: 9836 - protein, 20 aa, Homo sapiens
  Payload ID: 1982;
  Gene Symbol: BRD3;
  Gene Name: bromodomain containing 3;
  ENSP ID: ENSP00000406749
MSTATTVAPAGIPATPGPVN

SEQ ID NO: 9837 - protein, 1362 aa, Homo sapiens
  Payload ID: 1983;
  Gene Symbol: BRD4;
  Gene Name: bromodomain containing 4;
  Uniprot ID:  O60885;
  ENSP ID: ENSP00000263377
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETEMAPKSKKKGHPGREQKKHHHHHHQQMQQAPAPVPQQPPPPPQQPPPPPPPQQQQQPPPPPPPPSMPQQAAPAMKSSPPPFIATQVPVLEPQLPGSVFDPIGHFTQPILHLPQPELPPHLPQPPEHSTPPHLNQHAVVSPPALHNALPQQPSRPSNRAAALPPKPARPPAVSPALTQTPLLPQPPMAQPPQVLLEDEEPPAPPLTSMQMQLYLQQLQKVQPPTPLLPSVKVQSQPPPPLPPPPHPSVQQQLQQQPPPPPPPQPQPPPQQQHQPPPRPVHLQPMQFSTHIQQPPPPQGQQPPHPPPGQQPPPPQPAKPQQVIQHHHSPRHHKSDPYSTGHLREAPSPLMIHSPQMSQFQSLTHQSPPQQNVQPKKQELRAASVVQPQPLVVVKEEKIHSPIIRSEPFSPSLRPEPPKHPESIKAPVHLPQRPEMKPVDVGRPVIRPPEQNAPPPGAPDKDKQKQEPKTPVAPKKDLKIKNMGSWASLVQKHPTTPSSTAKSSSDSFEQFRRAAREKEEREKALKAQAEHAEKEKERLRQERMRSREDEDALEQARRAHEEARRRQEQQQQQRQEQQQQQQQQAAAVAAAATPQAQSSQPQSMLDQQRELARKREQERRRREAMAATIDMNFQSDLLSIFEENLF

SEQ ID NO: 9838 - protein, 794 aa, Homo sapiens
  Payload ID: 1983;
  Gene Symbol: BRD4;
  Gene Name: bromodomain containing 4;
  Uniprot ID:  O60885;
  ENSP ID: ENSP00000353112
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETAFCTSGDFVSPGPSPYHSHVQCGRFREMLRWFLVDVEQTAAGQPHRQSAAGPAITWAPAIAYPSPECARCCVGCS

SEQ ID NO: 9839 - protein, 722 aa, Homo sapiens
  Payload ID: 1983;
  Gene Symbol: BRD4;
  Gene Name: bromodomain containing 4;
  Uniprot ID:  O60885;
  ENSP ID: ENSP00000360901
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKKTKKNNSSNSNVSKKEPAPMKSKPPPTYESEEEDKCKPMSYEEKRQLSLDINKLPGEKLGRVVHIIQSREPSLKNSNPDEIEIDFETLKPSTLRELERYVTSCLRKKRKPQAEKVDVIAGSSKMKGFSSSESESSSESSSSDSEDSETGPA

SEQ ID NO: 9840 - protein, 146 aa, Homo sapiens
  Payload ID: 1983;
  Gene Symbol: BRD4;
  Gene Name: bromodomain containing 4;
  ENSP ID: ENSP00000470108
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKFRPQM

SEQ ID NO: 9841 - protein, 572 aa, Homo sapiens
  Payload ID: 1983;
  Gene Symbol: BRD4;
  Gene Name: bromodomain containing 4;
  ENSP ID: ENSP00000470481
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPMDMGTIKKRLENNYYWNAQECIQDFNTMFTNCYIYNKPGDDIVLMAEALEKLFLQKINELPTEETEIMIVQAKGRGRGRKETGTAKPGVSTVPNTTQASTPPQTQTPQPNPPPVQATPHPFPAVTPDLIVQTPVMTVVPPQPLQTPPPVPPQPQPPPAPAPQPVQSHPPIIAATPQPVKTKKGVKRKADTTTPTTIDPIHEPPSLPPEPKTTKLGQRRESSRPVKPPKKDVPDSQQHPAPEKSSKVSEQLKCCSGILKEMFAKKHAAYAWPFYKPVDVEALGLHDYCDIIKHPMDMSTIKSKLEAREYRDAQEFGADVRLMFSNCYKYNPPDHEVVAMARKLQDVFEMRFAKMPDEPEEPVVAVSSPAVPPPTKVVAPPSSSDSSSDSSSDSDSSTDDSEEERAQRLAELQEQLKAVHEQLAALSQPQQNKPKKKEKDKKEKKKEKHKRKEEVEENKKSKAKEPPPKK

SEQ ID NO: 9842 - protein, 105 aa, Homo sapiens
  Payload ID: 1983;
  Gene Symbol: BRD4;
  Gene Name: bromodomain containing 4;
  ENSP ID: ENSP00000471240
MSAESGPGTRLRNLPVMGDGLETSQMSTTQAQAQPQPANAASTNPPPPETSNPNKPKRQTNQLQYLLRVVLKTLWKHQFAWPFQQPVDAVKLNLPDYYKIIKTPM

SEQ ID NO: 9843 - protein, 146 aa, Homo sapiens; identical to SEQ ID NO: 9840
  Payload ID: 1983;
  Gene Symbol: BRD4;
  Gene Name: bromodomain containing 4;
  ENSP ID: ENSP00000486621

SEQ ID NO: 9844 - protein, 651 aa, Homo sapiens
  Payload ID: 1984;
  Gene Symbol: BRD7;
  Gene Name: bromodomain containing 7;
  Uniprot ID:  Q9NPI1;
  ENSP ID: ENSP00000378180
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 9845 - protein, 652 aa, Homo sapiens
  Payload ID: 1984;
  Gene Symbol: BRD7;
  Gene Name: bromodomain containing 7;
  Uniprot ID:  Q9NPI1;
  ENSP ID: ENSP00000378181
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEQITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 9846 - protein, 32 aa, Homo sapiens
  Payload ID: 1984;
  Gene Symbol: BRD7;
  Gene Name: bromodomain containing 7;
  ENSP ID: ENSP00000458430
PSPVMENNFVDLTEDTEEPKKTDVAECGPGGS

SEQ ID NO: 9847 - protein, 109 aa, Homo sapiens
  Payload ID: 1984;
  Gene Symbol: BRD7;
  Gene Name: bromodomain containing 7;
  ENSP ID: ENSP00000461556
QKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 9848 - protein, 951 aa, Homo sapiens
  Payload ID: 1985;
  Gene Symbol: BRD8;
  Gene Name: bromodomain containing 8;
  Uniprot ID:  Q9H0E9;
  ENSP ID: ENSP00000230901
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 9849 - protein, 1235 aa, Homo sapiens
  Payload ID: 1985;
  Gene Symbol: BRD8;
  Gene Name: bromodomain containing 8;
  Uniprot ID:  Q9H0E9;
  ENSP ID: ENSP00000254900
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFMGHEWVWLDSEQDHPNDSELSNDCRSLFSSWDSSLDLDVGNWRETEDPEAEELEESSPEREPSELLVGDGGSEESQEAARKASHQNLLHFLSEVAYLMEPLCISSNESSEGCCPPSGTRQEGREIKASEGERELCRETEELSAKGDPLVAEKPLGENGKPEVASAPSVICTVQGLLTESEEGEAQQESKGEDQGEVYVSEMEDQPPSGECDDAFNIKETPLVDTLFSHATSSKLTDLSQDDPVQDHLLFKKTLLPVWKMIASHRFSSPFLKPVSERQAPGYKDVVKRPMDLTSLKRNLSKGRIRTMAQFLRDLMLMFQNAVMYNDSDHHVYHMAVEMRQEVLEQIQVLNIWLDKRKGSSSLEGEPANPVDDGKPVF

SEQ ID NO: 9850 - protein, 878 aa, Homo sapiens
  Payload ID: 1985;
  Gene Symbol: BRD8;
  Gene Name: bromodomain containing 8;
  ENSP ID: ENSP00000384845
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 9851 - protein, 336 aa, Homo sapiens
  Payload ID: 1985;
  Gene Symbol: BRD8;
  Gene Name: bromodomain containing 8;
  ENSP ID: ENSP00000392646
DLDVGNWRETEDPEAEELEESSPEREPSELLVGDGGSEESQEAARKASHQNLLHFLSEVAYLMEPLCISSNESSEGCCPPSGTRQEGREIKASEGERELCRETEELSAKGDPLVAEKPLGENGKPEVASAPSVICTVQGLLTESEEGEAQQESKGEDQGEVYVSEMEDQPPSGECDDAFNIKETPLVDTLFSHATSSKLTDLSQDDPVQDHLLFKKTLLPVWKMIASHRFSSPFLKPVSERQAPGYKDVVKRPMDLTSLKRNLSKGRIRTMAQFLRDLMLMFQNAVMYNDSDHHVYHMAVEMRQEVLEQIQVLYADTCSLWNLDFRTPMRIKVISR

SEQ ID NO: 9852 - protein, 866 aa, Homo sapiens
  Payload ID: 1985;
  Gene Symbol: BRD8;
  Gene Name: bromodomain containing 8;
  Uniprot ID:  Q9H0E9;
  ENSP ID: ENSP00000394330
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDGGTRGRRCAIEADMKMKK

SEQ ID NO: 9853 - protein, 67 aa, Homo sapiens
  Payload ID: 1985;
  Gene Symbol: BRD8;
  Gene Name: bromodomain containing 8;
  ENSP ID: ENSP00000396487
MATGTGKHKLLSTGPTEPWSIREKLCLASSVMRSGDQNWLECSGAIWAHCSLLTSWAQGILLPQLPK

SEQ ID NO: 9854 - protein, 892 aa, Homo sapiens
  Payload ID: 1985;
  Gene Symbol: BRD8;
  Gene Name: bromodomain containing 8;
  ENSP ID: ENSP00000398067
GKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDGGTRGRRCAIEADMKMKK

SEQ ID NO: 9855 - protein, 857 aa, Homo sapiens
  Payload ID: 1985;
  Gene Symbol: BRD8;
  Gene Name: bromodomain containing 8;
  ENSP ID: ENSP00000398084
  MOD_RES (1)..(1): Any amino acid
XHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDGGTRGRRCAIEADMKMKK

SEQ ID NO: 9856 - protein, 79 aa, Homo sapiens
  Payload ID: 1985;
  Gene Symbol: BRD8;
  Gene Name: bromodomain containing 8;
  ENSP ID: ENSP00000398676
MATGTGKHKLLSTGPTEPWSIREKLCLASSVMRSGDQNWVSVSRAIKPFAEPGRPPDWFSQKHCASQYSELLETTETPK

SEQ ID NO: 9857 - protein, 861 aa, Homo sapiens
  Payload ID: 1985;
  Gene Symbol: BRD8;
  Gene Name: bromodomain containing 8;
  ENSP ID: ENSP00000398873
GKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDGGTRGRRCAIEADMKMKK

SEQ ID NO: 9858 - protein, 187 aa, Homo sapiens
  Payload ID: 1985;
  Gene Symbol: BRD8;
  Gene Name: bromodomain containing 8;
  ENSP ID: ENSP00000407129
KETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVNESEMAVASGHLNSTGVLLEVGGVLPMIHGGEIQQTPNTVAASPAASVSQPDNCVPMEAVGDPHTVTVSMDSSEISMIINSIKE

SEQ ID NO: 9859 - protein, 122 aa, Homo sapiens
  Payload ID: 1985;
  Gene Symbol: BRD8;
  Gene Name: bromodomain containing 8;
  ENSP ID: ENSP00000407414
MATGTGKHKLLSTGPTEPWSIREKLCLASSVMRSGDQNWGWSYSVTQAGVQWRDLGSLQPLDFLGSRDPPTSAAQVAGTTGRRVSVSRAIKPFAEPGRPPDWFSQKHCASQYSELLETTETP

SEQ ID NO: 9860 - protein, 39 aa, Homo sapiens
  Payload ID: 1985;
  Gene Symbol: BRD8;
  Gene Name: bromodomain containing 8;
  ENSP ID: ENSP00000414625
MATGTGKHKLLSTGPTEPWSIREKLCLASSVMRSGDQNW

SEQ ID NO: 9861 - protein, 36 aa, Homo sapiens
  Payload ID: 1985;
  Gene Symbol: BRD8;
  Gene Name: bromodomain containing 8;
  ENSP ID: ENSP00000420884
  MOD_RES (1)..(1): Any amino acid
XISAKSLRGRDSTRKQDASEKDSVPMGSPAFLLSLF

SEQ ID NO: 9862 - protein, 195 aa, Homo sapiens
  Payload ID: 1985;
  Gene Symbol: BRD8;
  Gene Name: bromodomain containing 8;
  ENSP ID: ENSP00000426385
GSKAPSIDGKEELDLAEKMDIAVSYTGEELDFETVGDIIAIIEDKASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHR

SEQ ID NO: 9863 - protein, 292 aa, Homo sapiens
  Payload ID: 1985;
  Gene Symbol: BRD8;
  Gene Name: bromodomain containing 8;
  ENSP ID: ENSP00000427126
HTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKGQSYSRARGKKERLLA

SEQ ID NO: 9864 - protein, 48 aa, Homo sapiens
  Payload ID: 1985;
  Gene Symbol: BRD8;
  Gene Name: bromodomain containing 8;
  ENSP ID: ENSP00000427475
MATGTGKHKLLSTGPTEPWSIREKLCLASSVMRSGDQNCIVLPSTRSF

SEQ ID NO: 9865 - protein, 90 aa, Homo sapiens
  Payload ID: 1986;
  Gene Symbol: BRD9;
  Gene Name: bromodomain containing 9;
  ENSP ID: ENSP00000417431
MMTGQTMSERGTKKRKRRRRRSPRRRSIWTMRKEGSERKRRSGSERGSTVTRRERLTTLILGRRWRWSRPQIGQSERAGHSQFSVELKML

SEQ ID NO: 9866 - protein, 90 aa, Homo sapiens; identical to SEQ ID NO: 9865
  Payload ID: 1986;
  Gene Symbol: BRD9;
  Gene Name: bromodomain containing 9;
  ENSP ID: ENSP00000419752

SEQ ID NO: 9867 - protein, 597 aa, Homo sapiens
  Payload ID: 1986;
  Gene Symbol: BRD9;
  Gene Name: bromodomain containing 9;
  Uniprot ID:  Q9H8M2;
  ENSP ID: ENSP00000419765
MGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 9868 - protein, 544 aa, Homo sapiens
  Payload ID: 1986;
  Gene Symbol: BRD9;
  Gene Name: bromodomain containing 9;
  Uniprot ID:  Q9H8M2;
  ENSP ID: ENSP00000419845
MMTGQTMSERGTKKRKRRRRRSPRRRSIWTMRKEGSERKRRSGSERGSTVTRRERLTTLILGRRWRWSRPQIGQSERAGHSQPKMRAHLFSNSWNTSSASFRDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 9869 - protein, 90 aa, Homo sapiens; identical to SEQ ID NO: 9865
  Payload ID: 1986;
  Gene Symbol: BRD9;
  Gene Name: bromodomain containing 9;
  ENSP ID: ENSP00000420080

SEQ ID NO: 9870 - protein, 90 aa, Homo sapiens; identical to SEQ ID NO: 9865
  Payload ID: 1986;
  Gene Symbol: BRD9;
  Gene Name: bromodomain containing 9;
  ENSP ID: ENSP00000420397

SEQ ID NO: 9871 - protein, 90 aa, Homo sapiens; identical to SEQ ID NO: 9865
  Payload ID: 1986;
  Gene Symbol: BRD9;
  Gene Name: bromodomain containing 9;
  ENSP ID: ENSP00000420492

SEQ ID NO: 9872 - protein, 225 aa, Homo sapiens
  Payload ID: 1986;
  Gene Symbol: BRD9;
  Gene Name: bromodomain containing 9;
  ENSP ID: ENSP00000420722
MKGYQSLVFNFFFLKLSAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKERLLALKRSMSFMQDMDFSQQAALLGNEDTAVEEPVPEVVPVQVETAKKSKKPSREVISCMFEPEGNACSLTDSTAEEHVLALVEHAADEARDRINRFLPGG

SEQ ID NO: 9873 - protein, 123 aa, Homo sapiens
  Payload ID: 1986;
  Gene Symbol: BRD9;
  Gene Name: bromodomain containing 9;
  ENSP ID: ENSP00000428194
SVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGPAIYHVMLY

SEQ ID NO: 9874 - protein, 174 aa, Homo sapiens
  Payload ID: 1986;
  Gene Symbol: BRD9;
  Gene Name: bromodomain containing 9;
  ENSP ID: ENSP00000429353
  MOD_RES (1)..(1): Any amino acid
XTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLVSFRACHLSRDAVLKSDRNLVSYYHGVCFVNLQISVLKLMLVSCA

SEQ ID NO: 9875 - protein, 92 aa, Homo sapiens
  Payload ID: 1986;
  Gene Symbol: BRD9;
  Gene Name: bromodomain containing 9;
  ENSP ID: ENSP00000430170
  MOD_RES (1)..(1): Any amino acid
XFVKDAGSYSKKVVDDLLDQITGGDHSRTLFQLKQRRNVPMKPPDEAKVGDTLGDSSSSVLEFMSMKSYPDVSVDISMLSSLGPAIYHVMLY

SEQ ID NO: 9876 - protein, 72 aa, Homo sapiens
  Payload ID: 1986;
  Gene Symbol: BRD9;
  Gene Name: bromodomain containing 9;
  ENSP ID: ENSP00000430510
  MOD_RES (1)..(1): Any amino acid
XSSSVLEFMSMKSYPDVSVDISMLSSLVSFRACHLSRDAVLKSDRNLVSYYHGVCFVNLQISVLKLMLVSCA

SEQ ID NO: 9877 - protein, 2920 aa, Homo sapiens
  Payload ID: 1987;
  Gene Symbol: BPTF;
  Gene Name: bromodomain PHD finger transcription factor;
  Uniprot ID:  Q12830;
  ENSP ID: ENSP00000307208
MRGRRGRPPKQPAAPAAERCAPAPPPPPPPPTSGPIGGLRSRHRGSSRGRWAAAQAEVAPKTRLSSPRGGSSSRRKPPPPPPAPPSTSAPGRGGRGGGGGRTGGGGGGGHLARTTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEKVSDLASRGQEPSKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVQSSTQTLSSGQTLNQVTVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 9878 - protein, 3046 aa, Homo sapiens
  Payload ID: 1987;
  Gene Symbol: BPTF;
  Gene Name: bromodomain PHD finger transcription factor;
  Uniprot ID:  Q12830;
  ENSP ID: ENSP00000315454
MRGRRGRPPKQPAAPAAERCAPAPPPPPPPPTSGPIGGLRSRHRGSSRGRWAAAQAEVAPKTRLSSPRGGSSSRRKPPPPPPAPPSTSAPGRGGRGGGGGRTGGGGGGGHLARTTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEKVSDLASRGQEPSKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVQSSTQTLSSGQTLNQVTVSSPSRPQLQIQQPQPQVIAVPQLQQQVQVLSQIQSQVVAQIQAQQSGVPQQIKLQLPIQIQQSSAVQTHQIQNVVTVQAASVQEQLQRVQQLRDQQQKKKQQQIEIKREHTLQASNQSEIIQKQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 9879 - protein, 810 aa, Homo sapiens
  Payload ID: 1987;
  Gene Symbol: BPTF;
  Gene Name: bromodomain PHD finger transcription factor;
  ENSP ID: ENSP00000334351
MVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLETTSLHPFFIPTGHHIGQIGSRQFRCVANPENLHWL

SEQ ID NO: 9880 - protein, 650 aa, Homo sapiens
  Payload ID: 1987;
  Gene Symbol: BPTF;
  Gene Name: bromodomain PHD finger transcription factor;
  ENSP ID: ENSP00000343837
  MOD_RES (1)..(1): Any amino acid
XTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDLCTNWYHGECVGITEKEAKKMDVYICNDCKRAQEGSSEELYCICRTPYDESQFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 9881 - protein, 2764 aa, Homo sapiens
  Payload ID: 1987;
  Gene Symbol: BPTF;
  Gene Name: bromodomain PHD finger transcription factor;
  ENSP ID: ENSP00000388405
MVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPEEPNKTCESSNTSATTTSIQPNLENSNSSSELNSSQSESAKAADDPENGERESHTPVSIQEEIVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEKVSDLASRGQEPSKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRSHNNKLQSTAS

SEQ ID NO: 9882 - protein, 2457 aa, Homo sapiens
  Payload ID: 1987;
  Gene Symbol: BPTF;
  Gene Name: bromodomain PHD finger transcription factor;
  ENSP ID: ENSP00000440854
MRGRRGRPPKQPAAPAAERCAPAPPPPPPPPTSGPIGGLRSRHRGSSRGRWAAAQAEVAPKTRLSSPRGGSSSRRKPPPPPPAPPSTSAPGRGGRGGGGGRTGGGGGGGHLARTTAARRAVNKVVYDDHESEEEEEEEDMVSEEEEEEDGDAEETQDSEDDEEDEMEEDDDDSDYPEEMEDDDDDASYCTESSFRSHSTYSSTPGRRKPRVHRPRSPILEEKDIPPLEFPKSSEDLMVPNEHIMNVIAIYEVLRNFGTVLRLSPFRFEDFCAALVSQEQCTLMAEMHVVLLKAVLREEDTSNTTFGPADLKDSVNSTLYFIDGMTWPEVLRVYCESDKEYHHVLPYQEAEDYPYGPVENKIKVLQFLVDQFLTTNIAREELMSEGVIQYDDHCRVCHKLGDLLCCETCSAVYHLECVKPPLEEVPEDEWQCEVCVAHKVPGVTDCVAEIQKNKPYIRHEPIGYDRSRRKYWFLNRRLIIEEDTENENEKKIWYYSTKVQLAELIDCLDKDYWEAELCKILEEMREEIHRHMDITEDLTNKARGSNKSFLAAANEEILESIRAKKGDIDNVKSPEETEKDKNETENDSKDAEKNREEFEDQSLEKDSDDKTPDDDPEQGKSEEPTEVGDKGNSVSANLGDNTTNATSEETSPSEGRSPVGCLSETPDSSNMAEKKVASELPQDVPVGDFKSEKSNGELSESPGAGKGASGSTRIITRLRNPDSKLSQLKSQQVAAAAHEANKLFKEGKEVLVVNSQGEISRLSTKKEVIMKGNINNYFKLGQEGKYRVYHNQYSTNSFALNKHQHREDHDKRRHLAHKFCLTPAGEFKWNGSVHGSKVLTISTLRLTITQLENNIPSSFLHPNWASHRANWIKAVQMCSKPREFALALAILECAVKPVVMLPIWRESLGHTRLHRMTSIEREEKEKVKKKEKKQEEEETMQQATWVKYTFPVKHQVWKQKGEEYRVTGYGGWSWISKTHVYRFVPKLPGNTNVNYRKSLEGTKNNMDENMDESDKRKCSRSPKKIKIEPDSEKDEVKGSDAAKGADQNEMDISKITEKKDQDVKELLDSDSDKPCKEEPMEVDDDMKTESHVNCQESSQVDVVNVSEGFHLRTSYKKKTKSSKLDGLLERRIKQFTLEEKQRLEKIKLEGGIKGIGKTSTNSSKNLSESPVITKAKEGCQSDSMRQEQSPNANNDQPEDLIQGCSESDSSVLRMSDPSHTTNKLYPKDRVLDDVSIRSPETKCPKQNSIENDIEEKVSDLASRGQEPSKSKTKGNDFFIDDSKLASADDIGTLICKNKKPLIQEESDTIVSSSKSALHSSVPKSTNDRDATPLSRAMDFEGKLGCDSESNSTLENSSDTVSIQDSSEEDMIVQNSNESISEQFRTREQDVEVLEPLKCELVSGESTGNCEDRLPVKGTEANGKKPSQQKKLEERPVNKCSDQIKLKNTTDKKNNENRESEKKGQRTSTFQINGKDNKPKIYLKGECLKEISESRVVSGNVEPKVNNINKIIPENDIKSLTVKESAIRPFINGDVIMEDFNERNSSETKSHLLSSSDAEGNYRDSLETLPSTKESDSTQTTTPSASCPESNSVNQVEDMEIETSEVKKVTSSPITSEEESNLSNDFIDENGLPINKNENVNGESKRKTVITEVTTMTSTVATESKTVIKVEKGDKQTVVSSTENCAKSTVTTTTTTVTKLSTPSTGGSVDIISVKEQSKTVVTTTVTDSLTTTGGTLVTSMTVSKEYSTRDKVKLMKFSRPKKTRSGTALPSYRKFVTKSSKKSIFVLPNDDLKKLARKGGIREVPYFNYNAKPALDIWPYPSPRPTFGITWRYRLQTVKSLAGVSLMLRLLWASLRWDDMAAKAPPGGGTTRTETSETEITTTEIIKRRDVGPYGIRSEYCIRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLTSATSTSNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQ

SEQ ID NO: 9883 - protein, 137 aa, Homo sapiens
  Payload ID: 1987;
  Gene Symbol: BPTF;
  Gene Name: bromodomain PHD finger transcription factor;
  ENSP ID: ENSP00000443949
  MOD_RES (1)..(1): Any amino acid
XDAEKNREEFEDQSLEKDSDDKTPDDDPEQGKSEEEPNKTCESSNTSATTTSIQPNLENSNSSSELNSSQSESAKAADDPENGERESHTPVSIQEEIVGDFKSEKSNGELSESPGAGKGASGSTRIITRLRNPDSKL

SEQ ID NO: 9884 - protein, 484 aa, Homo sapiens
  Payload ID: 1987;
  Gene Symbol: BPTF;
  Gene Name: bromodomain PHD finger transcription factor;
  ENSP ID: ENSP00000462535
  MOD_RES (1)..(1): Any amino acid
XNIQSSASQPPRPQQGQVKLTMAQLTQLTQGHGGNQGLTVVIQGQGQTTGQLQLIPQGVTVLPGPGQQLMQAAMPNGTVQRFLFTPLATTATTASTTTTTVSTTAAGTGEQRQSKLSPQMQVHQDKTLPPAQSSSVGPAEAQPQTAQPSAQPQPQTQPQSPAQPEVQTQPEVQTQTTVSSHVPSEAQPTHAQSSKPQVAAQSQPQSNVQGQSPVRVQSPSQTRIRPSTPSQLSPGQQSQVQTTTSQPIPIQPHTSLQIPSQGQPQSQPQVVMKHNAVIEHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESK

SEQ ID NO: 9885 - protein, 64 aa, Homo sapiens
  Payload ID: 1987;
  Gene Symbol: BPTF;
  Gene Name: bromodomain PHD finger transcription factor;
  ENSP ID: ENSP00000462703
  MOD_RES (1)..(1): Any amino acid
XRYYEKLTEFVADMTKIFDNCRYYNPSDSPFYQCAEVLESFFVQKLKGFKASRVNERTWLLLPD

SEQ ID NO: 9886 - protein, 69 aa, Homo sapiens
  Payload ID: 1987;
  Gene Symbol: BPTF;
  Gene Name: bromodomain PHD finger transcription factor;
  ENSP ID: ENSP00000463736
  MOD_RES (1)..(1): Any amino acid
XLTPLTEKDYEGLKRVLRSLQAHKMAWPFLEPVDPNDAPDYYGVIKEPMGLITTNCSLQLLKVQRVNLT

SEQ ID NO: 9887 - protein, 339 aa, Homo sapiens
  Payload ID: 1987;
  Gene Symbol: BPTF;
  Gene Name: bromodomain PHD finger transcription factor;
  ENSP ID: ENSP00000463776
  MOD_RES (1)..(1): Any amino acid
XRKIICPIGVPETPKETPTPQRKGLRSSALRPKRPETPKQTGPVIIETWVAEEELELWEIRAFAERVEKEKAQAVEQQAKKRLEQQKPTVIATSTTSPTSSTTSTISPAQKVMVAPISGSVTTGTKMVLTTKVGSPATVTFQQNKNFHQTFATWVKQGQSNSATSTAATSATTIASTGQTFQITGNPVTMAGKVITKLPLPANSKIVAVNVPATQGGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMTQIIRGQPVSTAVSAPNTVSSTPGQKSLT

SEQ ID NO: 9888 - protein, 420 aa, Homo sapiens
  Payload ID: 1987;
  Gene Symbol: BPTF;
  Gene Name: bromodomain PHD finger transcription factor;
  ENSP ID: ENSP00000463845
  MOD_RES (1)..(1): Any amino acid
XHLKQKKSMTPAEREENQRMIVCNQVMKYILDKIDKEEKQAAKKRKREESVEQKRSKQNATKLSALLFKHKEQLRAEILKKRALLDKDLQIEVQEELKRDLKIKKEKDLMQLAQATAVAAPCPPVTPAPPAPPAPPPSPPPPPAVQHTGLLSTPTLPAASQKRKREEEKDSSSKSKKKKMISTTSKETKKDTKLYCICKTPYDESKFYIGCDLCTNWYHGECVGITEKEAKKMDVYICNDCKRAQEGSSEELYCICRTPYDESQFYIGCDRCQNWYHGRCVGILQSEAELIDEYVCPQCQSTEDAMTVLTPLTEKDYEGLKRVLRSLQAHKMAWPFLEPVDPNDAPDYYGVIKEPMDLATMEERVQRRYYEKLTEFVADMTKIFDNCRYYNPSDSPFYQCAEVLESFFVQKLKGFKASRL

SEQ ID NO: 9889 - protein, 947 aa, Homo sapiens
  Payload ID: 1988;
  Gene Symbol: BRDT;
  Gene Name: bromodomain, testis-specific;
  Uniprot ID:  Q58F21;
  ENSP ID: ENSP00000354568
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 9890 - protein, 874 aa, Homo sapiens
  Payload ID: 1988;
  Gene Symbol: BRDT;
  Gene Name: bromodomain, testis-specific;
  Uniprot ID:  Q58F21;
  ENSP ID: ENSP00000359416
MDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 9891 - protein, 901 aa, Homo sapiens
  Payload ID: 1988;
  Gene Symbol: BRDT;
  Gene Name: bromodomain, testis-specific;
  Uniprot ID:  Q58F21;
  ENSP ID: ENSP00000378038
MSLPSRQTAIIVNPPPPEYINTKKNGRLTNQLQYLQKVVLKDLWKHSFSWPFQRPVDAVKLQLPPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 9892 - protein, 947 aa, Homo sapiens; identical to SEQ ID NO: 9889
  Payload ID: 1988;
  Gene Symbol: BRDT;
  Gene Name: bromodomain, testis-specific;
  Uniprot ID:  Q58F21;
  ENSP ID: ENSP00000384051

SEQ ID NO: 9893 - protein, 951 aa, Homo sapiens
  Payload ID: 1988;
  Gene Symbol: BRDT;
  Gene Name: bromodomain, testis-specific;
  Uniprot ID:  Q58F21;
  ENSP ID: ENSP00000387822
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGKAGGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 9894 - protein, 176 aa, Homo sapiens
  Payload ID: 1988;
  Gene Symbol: BRDT;
  Gene Name: bromodomain, testis-specific;
  ENSP ID: ENSP00000396351
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQE

SEQ ID NO: 9895 - protein, 155 aa, Homo sapiens
  Payload ID: 1988;
  Gene Symbol: BRDT;
  Gene Name: bromodomain, testis-specific;
  ENSP ID: ENSP00000400002
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIA

SEQ ID NO: 9896 - protein, 14 aa, Homo sapiens
  Payload ID: 1988;
  Gene Symbol: BRDT;
  Gene Name: bromodomain, testis-specific;
  ENSP ID: ENSP00000400199
MSLPSRQTAIIVNP

SEQ ID NO: 9897 - protein, 462 aa, Homo sapiens
  Payload ID: 1988;
  Gene Symbol: BRDT;
  Gene Name: bromodomain, testis-specific;
  ENSP ID: ENSP00000404969
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKE

SEQ ID NO: 9898 - protein, 31 aa, Homo sapiens
  Payload ID: 1988;
  Gene Symbol: BRDT;
  Gene Name: bromodomain, testis-specific;
  ENSP ID: ENSP00000408138
MSLPSRQTAIIVNPPPPEYINTKKNGRLTNQ

SEQ ID NO: 9899 - protein, 52 aa, Homo sapiens
  Payload ID: 1988;
  Gene Symbol: BRDT;
  Gene Name: bromodomain, testis-specific;
  ENSP ID: ENSP00000408625
MSLPSRQTAIIVNPPPPEYINTKKNGRLTNQLQYLQKVVLKDLWKHSFSWPF

SEQ ID NO: 9900 - protein, 155 aa, Homo sapiens; identical to SEQ ID NO: 9895
  Payload ID: 1988;
  Gene Symbol: BRDT;
  Gene Name: bromodomain, testis-specific;
  ENSP ID: ENSP00000410587

SEQ ID NO: 9901 - protein, 96 aa, Homo sapiens
  Payload ID: 1988;
  Gene Symbol: BRDT;
  Gene Name: bromodomain, testis-specific;
  ENSP ID: ENSP00000414349
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIE

SEQ ID NO: 9902 - protein, 200 aa, Homo sapiens
  Payload ID: 1988;
  Gene Symbol: BRDT;
  Gene Name: bromodomain, testis-specific;
  ENSP ID: ENSP00000416714
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSS

SEQ ID NO: 9903 - protein, 63 aa, Homo sapiens
  Payload ID: 1988;
  Gene Symbol: BRDT;
  Gene Name: bromodomain, testis-specific;
  ENSP ID: ENSP00000446599
MDLNTIKKRLENKYYAKASECIEDFNTMFSNCYLYNKPGDDIVLMAQALEKLFMQKLSQMPQE

SEQ ID NO: 9904 - protein, 100 aa, Homo sapiens
  Payload ID: 1988;
  Gene Symbol: BRDT;
  Gene Name: bromodomain, testis-specific;
  ENSP ID: ENSP00000447394
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNT

SEQ ID NO: 9905 - protein, 659 aa, Homo sapiens
  Payload ID: 1989;
  Gene Symbol: BTK;
  Gene Name: Bruton agammaglobulinemia tyr kinase;
  Uniprot ID:  Q06187;
  ENSP ID: ENSP00000308176
MAAVILESIFLKRSQQKKKTSPLNFKKRLFLLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLLNYLREMRHRFQTQQLLEMCKDVCEAMEYLESKQFLHRDLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 9906 - protein, 483 aa, Homo sapiens
  Payload ID: 1989;
  Gene Symbol: BTK;
  Gene Name: Bruton agammaglobulinemia tyr kinase;
  ENSP ID: ENSP00000361971
MAAVILESIFLKRSQQKKKTSPLNFKKRLFLLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 9907 - protein, 568 aa, Homo sapiens [sequence omitted]

SEQ ID NO: 9908 - protein, 693 aa, Homo sapiens
  Payload ID: 1989;
  Gene Symbol: BTK;
  Gene Name: Bruton agammaglobulinemia tyr kinase;
  Uniprot ID:  Q06187;
  ENSP ID: ENSP00000483570
MASWSIQQMVIGCPLCGRHCSGGEHTGELQKEEAMAAVILESIFLKRSQQKKKTSPLNFKKRLFLLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDVAIKMIKEGSMSEDEFIEEAKVMMNLSHEKLVQLYGVCTKQRPIFIITEYMANGCLLNYLREMRHRFQTQQLLEMCKDVCEAMEYLESKQFLHRDLAARNCLVNDQGVVKVSDFGLSRYVLDDEYTSSVGSKFPVRWSPPEVLMYSKFSSKSDIWAFGVLMWEIYSLGKMPYERFTNSETAEHIAQGLRLYRPHLASEKVYTIMYSCWHEKADERPTFKILLSNILDVMDEES

SEQ ID NO: 9909 - protein, 353 aa, Homo sapiens
  Payload ID: 1990;
  Gene Symbol: BRIX1;
  Gene Name: BRX1, biogenesis of ribosomes;
  Uniprot ID:  Q8TDN6;
  ENSP ID: ENSP00000338862
MAATKRKRRGGFAVQAKKPKRNEIDAEPPAKRHATAEEVEEEERDRIPGPVCKGKWKNKERILIFSSRGINFRTRHLMQDLRMLMPHSKADTKMDRKDKLFVINEVCEMKNCNKCIYFEAKKKQDLYMWLSNSPHGPSAKFLVQNIHTLAELKMTGNCLKGSRPLLSFDPAFDELPHYALLKELLIQIFSTPRYHPKSQPFVDHVFTFTILDNRIWFRNFQIIEEDAALVEIGPRFVLNLIKIFQGSFGGPTLYENPHYQSPNMHRRVIRSITAAKYREKQQVKDVQKLRKKEPKTLLPHDPTADVFVTPAEEKPIEIQWVKPEPKVDLKARKKRIYKRQRKMKQRMDSGKTK

SEQ ID NO: 9910 - protein, 474 aa, Homo sapiens
  Payload ID: 1991;
  Gene Symbol: BSDC1;
  Gene Name: BSD domain containing 1;
  Uniprot ID:  Q9NW68;
  ENSP ID: ENSP00000344816
MAEGEDVGWWRSWLQQSYQAVKEKSSEALEFMKRDLTEFTQVVQHDTACTIAATASVVKEKLAIAACSRGACFLCPFSIQTEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGEVSGPGGSEGSEPNGPGCESSPQPAQLSPQEGPCSCLR

SEQ ID NO: 9911 - protein, 64 aa, Homo sapiens
  Payload ID: 1991;
  Gene Symbol: BSDC1;
  Gene Name: BSD domain containing 1;
  ENSP ID: ENSP00000362620
MAEGEDVGWWRSWLQQSYQAVKEKSSEALEFMKRDLTEFTQVVQHDTACTIAATASVVKEKLAG

SEQ ID NO: 9912 - protein, 447 aa, Homo sapiens
  Payload ID: 1991;
  Gene Symbol: BSDC1;
  Gene Name: BSD domain containing 1;
  Uniprot ID:  Q9NW68;
  ENSP ID: ENSP00000397759
MAEGEDVGWWRSWLQQSYQAVKEKSSEALEFMKRDLTEFTQVVQHDTACTIAATASVVKEKLAIAACSRGACFLCPFSIQTEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9913 - protein, 374 aa, Homo sapiens
  Payload ID: 1991;
  Gene Symbol: BSDC1;
  Gene Name: BSD domain containing 1;
  Uniprot ID:  Q9NW68;
  ENSP ID: ENSP00000405752
MAEGEDVGWWRSWLQQSYQAVKEKSSEALEFMKRDLTEFTQVVQHDTACTIAATASVVKEKLAARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9914 - protein, 430 aa, Homo sapiens
  Payload ID: 1991;
  Gene Symbol: BSDC1;
  Gene Name: BSD domain containing 1;
  Uniprot ID:  Q9NW68;
  ENSP ID: ENSP00000412173
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9915 - protein, 428 aa, Homo sapiens
  Payload ID: 1991;
  Gene Symbol: BSDC1;
  Gene Name: BSD domain containing 1;
  Uniprot ID:  Q9NW68;
  ENSP ID: ENSP00000414103
MAEGEDVGWWRSWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKETRSQFTVDFLWKISVTLLEPLGQSASPLFSNLPFPRLKHGHQ

SEQ ID NO: 9916 - protein, 335 aa, Homo sapiens
  Payload ID: 1991;
  Gene Symbol: BSDC1;
  Gene Name: BSD domain containing 1;
  Uniprot ID:  Q9NW68;
  ENSP ID: ENSP00000432382
MAEGEDVGWWRSWLQQSYQAVKEKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPVAKISTFPEGEPGPQSPCEENLVTSVEPPAEVTPSESSESISLVTQIANPATAPEARVLPKDLSQKLLEASLEEQGLAVDVGETGPSPPIHSKPLTPAGHTGGPEPRPPARVETLREEAPTDLRVFELNSDSGKSTPSNNGKKGSSTDISEDWEKDFDLDMTEEEVQMALSKVDASGELEDVEWEDWE

SEQ ID NO: 9917 - protein, 177 aa, Homo sapiens
  Payload ID: 1991;
  Gene Symbol: BSDC1;
  Gene Name: BSD domain containing 1;
  ENSP ID: ENSP00000432524
MVAELAAAELPSSQREGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRDALKQRAEQSISEEPGWEEEEEELMGISPISPKEAKVPV

SEQ ID NO: 9918 - protein, 89 aa, Homo sapiens
  Payload ID: 1991;
  Gene Symbol: BSDC1;
  Gene Name: BSD domain containing 1;
  ENSP ID: ENSP00000432841
MAEGEDVGWWRSWLQQSYQAVKEKSSEALEFMKRDLTEFTQVVQHDTACTIAATASVVKEKLAGPRNCLTPGFPSSAWRRRRGRSQSSL

SEQ ID NO: 9919 - protein, 156 aa, Homo sapiens
  Payload ID: 1991;
  Gene Symbol: BSDC1;
  Gene Name: BSD domain containing 1;
  ENSP ID: ENSP00000435888
MAEGEDVGWWRSWLQQSYQAVKEKTEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVH

SEQ ID NO: 9920 - protein, 1849 aa, Homo sapiens
  Payload ID: 1992;
  Gene Symbol: BTAF1;
  Gene Name: BTAF1 RNA polymerase II, B-TFIID transcription factor-associated, 170kDa;
  Uniprot ID:  O14981;
  ENSP ID: ENSP00000265990
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEMIQQHQEWLEDLVIRLLCVFALDRFGDFVSDEVVAPVRETCAQTLGVVLKHMNETGVHKTVDVLLKLLTQEQWEVRHGGLLGIKYALAVRQDVINTLLPKVLTRIIEGLQDLDDDVRAVAAASLVPVVESLVYLQTQKVPFIINTLWDALLELDDLTASTNSIMTLLSSLLTYPQVQQCSIQQSLTVLVPRVWPFLHHTISSVRRAALETLFTLLSTQDQNSSSWLIPILPDMLRHIFQFCVLESSQEILDLIHKVWMELLSKASVQYVVAAACPWMGAWLCLMMQPSHLPIDLNMLLEVKARAKEKTGGKVRQGQSQNKEVLQEYIAGADTIMEDPATRDFVVMRARMMAAKLLGALCCCICDPGVNVVTQEIKPAESLGQLLLFHLNSKSALQRISVALVICEWAALQKECKAVTLAVQPRLLDILSEHLYYDEIAVPFTRMQNECKQLISSLADVHIEVGNRVNNNVLTIDQASDLVTTVFNEATSSFDLNPQVLQQLDSKRQQVQMTVTETNQEWQVLQLRVHTFAACAVVSLQQLPEKLNPIIKPLMETIKKEENTLVQNYAAQCIAKLLQQCTTRTPCPNSKIIKNLCSSLCVDPYLTPCVTCPVPTQSGQENSKGSTSEKDGMHHTVTKHRGIITLYRHQKAAFAITSRRGPTPKAVKAQIADLPAGSSGNILVELDEAQKPYLVQRRGAEFALTTIVKHFGGEMAVKLPHLWDAMVGPLRNTIDINNFDGKSLLDKGDSPAQELVNSLQVFETAAASMDSELHPLLVQHLPHLYMCLQYPSTAVRHMAARCVGVMSKIATMETMNIFLEKVLPWLGAIDDSVKQEGAIEALACVMEQLDVGIVPYIVLLVVPVLGRMSDQTDSVRFMATQCFATLIRLMPLEAGIPDPPNMSAELIQLKAKERHFLEQLLDGKKLENYKIPVPINAELRKYQQDGVNWLAFLNKYKLHGILCDDMGLGKTLQSICILAGDHCHRAQEYARSKLAECMPLPSLVVCPPTLTGHWVDEVGKFCSREYLNPLHYTGPPTERIRLQHQVKRHNLIVASYDVVRNDIDFFRNIKFNYCILDEGHVIKNGKTKLSKAVKQLTANYRIILSGTPIQNNVLELWSLFDFLMPGFLGTERQFAARYGKPILASRDARSSSREQEAGVLAMDALHRQVLPFLLRRMKEDVLQDLPPKIIQDYYCTLSPLQVQLYEDFAKSRAKCDVDETVSSATLSEETEKPKLKATGHVFQALQYLRKLCNHPALVLTPQHPEFKTTAEKLAVQNSSLHDIQHAPKLSALKQLLLDCGLGNGSTSESGTESVVAQHRILIFCQLKSMLDIVEHDLLKPHLPSVTYLRLDGSIPPGQRHSIVSRFNNDPSIDVLLLTTHVGGLGLNLTGADTVVFVEHDWNPMRDLQAMDRAHRIGQKRVVNVYRLITRGTLEEKIMGLQKFKMNIANTVISQENSSLQSMGTDQLLDLFTLDKDGKAEKADTSTSGKASMKSILENLSDLWDQEQYDSEYSLENFMHSLK

SEQ ID NO: 9921 - protein, 1849 aa, Homo sapiens [sequence omitted]

SEQ ID NO: 9922 - protein, 482 aa, Homo sapiens
  Payload ID: 1993;
  Gene Symbol: BTBD1;
  Gene Name: BTB (POZ) domain containing 1;
  Uniprot ID:  Q9H0C5;
  ENSP ID: ENSP00000261721
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQIIEYEKKQTLGQNDTGFSCDGTANTFRVMFKEPIEILPNVCYTACATLKGPDSHYGTKGLKKVVHETPAASKTVFFFFSSPGNNNGTSIEDGQIPEIIFYT

SEQ ID NO: 9923 - protein, 385 aa, Homo sapiens
  Payload ID: 1993;
  Gene Symbol: BTBD1;
  Gene Name: BTB (POZ) domain containing 1;
  Uniprot ID:  Q9H0C5;
  ENSP ID: ENSP00000368713
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRSLNMRKSKPWDRMIPALVVMGQLTHSGSCSRNP

SEQ ID NO: 9924 - protein, 37 aa, Homo sapiens
  Payload ID: 1993;
  Gene Symbol: BTBD1;
  Gene Name: BTB (POZ) domain containing 1;
  ENSP ID: ENSP00000453104
  MOD_RES (1)..(1): Any amino acid
XKYAVPALEAHCVEFLTKHLRADNAFMLLTQIHSVQF

SEQ ID NO: 9925 - protein, 475 aa, Homo sapiens
  Payload ID: 1994;
  Gene Symbol: BTBD10;
  Gene Name: BTB (POZ) domain containing 10;
  Uniprot ID:  Q9BSF8;
  ENSP ID: ENSP00000278174
MAGRPHPYDGNSSDPENWDRKLHSRPRKLYKHSSTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKKRPGGRPEVIYNYVQRPFIRMSWEKEEGKSRHVDFQCVKSKSITNLAAAAADIPQDQLVVMHPTPQVDELDILPIHPPSGNSDLDPDAQNPML

SEQ ID NO: 9926 - protein, 483 aa, Homo sapiens
  Payload ID: 1994;
  Gene Symbol: BTBD10;
  Gene Name: BTB (POZ) domain containing 10;
  Uniprot ID:  Q9BSF8;
  ENSP ID: ENSP00000431186
MPKDADLAFSASLFERAESLYTLISKFFSCFCVSTLAYTKGSTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKKRPGGRPEVIYNYVQRPFIRMSWEKEEGKSRHVDFQCVKSKSITNLAAAAADIPQDQLVVMHPTPQVDELDILPIHPPSGNSDLDPDAQNPML

SEQ ID NO: 9927 - protein, 64 aa, Homo sapiens
  Payload ID: 1994;
  Gene Symbol: BTBD10;
  Gene Name: BTB (POZ) domain containing 10;
  ENSP ID: ENSP00000431572
MAGRPHPYDGNSSDPENWDRKLHSRPRKLYKHSSTSSRIAKGGVDHTKMSLHGASGGHERSRDR

SEQ ID NO: 9928 - protein, 66 aa, Homo sapiens
  Payload ID: 1994;
  Gene Symbol: BTBD10;
  Gene Name: BTB (POZ) domain containing 10;
  ENSP ID: ENSP00000434579
MAGRPHPYDGNSSDPENWDRKLHSRPRKLYKHSSTSSRIAKGGVDHTKMSLHGASGGHERSRDRRR

SEQ ID NO: 9929 - protein, 36 aa, Homo sapiens
  Payload ID: 1994;
  Gene Symbol: BTBD10;
  Gene Name: BTB (POZ) domain containing 10;
  ENSP ID: ENSP00000434857
MAGRPHPYDGNSSDPENWDRKLHSRPRKLYKHSRRS

SEQ ID NO: 9930 - protein, 427 aa, Homo sapiens
  Payload ID: 1994;
  Gene Symbol: BTBD10;
  Gene Name: BTB (POZ) domain containing 10;
  ENSP ID: ENSP00000435257
MSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGREHNFTRPNEKGEYEVAEGIGSTVFRAILDYYKTGIIRCPDGISIPELREACDYLCISFEYSTIKCRDLSALMHELSNDGARRQFEFYLEEMILPLMVASAQSGERECHIVVLTDDDVVDWDEEYPPQMGEEYSQIIYSTKLYRFFKYIENRDVAKSVLKERGLKKIRLGIEGYPTYKEKVKKRPGGRPEVIYNYVQRPFIRMSWEKEEGKSRHVDFQCVKSKSITNLAAAAADIPQDQLVVMHPTPQVDELDILPIHPPSGNSDLDPDAQNPML

SEQ ID NO: 9931 - protein, 202 aa, Homo sapiens
  Payload ID: 1994;
  Gene Symbol: BTBD10;
  Gene Name: BTB (POZ) domain containing 10;
  ENSP ID: ENSP00000435303
MAGRPHPYDGNSSDPENWDRKLHSRPRKLYKHSSTSSRIAKGGVDHTKMSLHGASGGHERSRDRRRSSDRSRDSSHERTESQLTPCIRNVTSPTRQHHVEREKDHSSSRPSSPRPQKASPNGSISSAGNSSRNSSQSSSDGSCKTAGEMVFVYENAKEGARNIRTSERVTLIVDNTRFVVDPSIFTAQPNTMLGRMFGSGLL

SEQ ID NO: 9932 - protein, 1104 aa, Homo sapiens
  Payload ID: 1995;
  Gene Symbol: BTBD11;
  Gene Name: BTB (POZ) domain containing 11;
  Uniprot ID:  A6QL63;
  ENSP ID: ENSP00000280758
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 9933 - protein, 641 aa, Homo sapiens
  Payload ID: 1995;
  Gene Symbol: BTBD11;
  Gene Name: BTB (POZ) domain containing 11;
  Uniprot ID:  A6QL63;
  ENSP ID: ENSP00000349690
MRKLRPKDSREPAPGSPVRSGCLQRLSHYSGIQRPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 9934 - protein, 237 aa, Homo sapiens
  Payload ID: 1995;
  Gene Symbol: BTBD11;
  Gene Name: BTB (POZ) domain containing 11;
  ENSP ID: ENSP00000407416
MVESLHGLDSRKGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQ

SEQ ID NO: 9935 - protein, 985 aa, Homo sapiens
  Payload ID: 1995;
  Gene Symbol: BTBD11;
  Gene Name: BTB (POZ) domain containing 11;
  Uniprot ID:  A6QL63;
  ENSP ID: ENSP00000413889
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 9936 - protein, 1007 aa, Homo sapiens
  Payload ID: 1995;
  Gene Symbol: BTBD11;
  Gene Name: BTB (POZ) domain containing 11;
  Uniprot ID:  A6QL63;
  ENSP ID: ENSP00000447319
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMEVRDPLWCWLS

SEQ ID NO: 9937 - protein, 222 aa, Homo sapiens
  Payload ID: 1995;
  Gene Symbol: BTBD11;
  Gene Name: BTB (POZ) domain containing 11;
  ENSP ID: ENSP00000447606
AAAAVPPAAAANHHHHHHHALHEAPKFTVETLEHTVNNDSEIWGLLQPYQHLICGKNASGDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSL

SEQ ID NO: 9938 - protein, 183 aa, Homo sapiens
  Payload ID: 1995;
  Gene Symbol: BTBD11;
  Gene Name: BTB (POZ) domain containing 11;
  Uniprot ID:  A6QL63;
  ENSP ID: ENSP00000448322
MSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 9939 - protein, 506 aa, Homo sapiens
  Payload ID: 1996;
  Gene Symbol: BTBD16;
  Gene Name: BTB (POZ) domain containing 16;
  Uniprot ID:  Q32M84;
  ENSP ID: ENSP00000260723
MIMSNTHKARLERRVTGSTNRWRLPKQPFSGDLLSLSQMCKALSIDFEEALRNPDRLCISQIQKFFFENFKNKDIQSGEADVILECLGFKWELHQPQLFQSETLAKLYLKALAQGTTHPLRELEELLRAQSPKKTKEKSPAKRIIISLKINDPLVTKVAFATALKNLYMSEVEINLEDLLGVLASAHILQFSGLFQRCVDVMIARLKPSTIKKFYEAGCKYKEEQLTTGCEKWLEMNLVPLGGTQIHLHKIPQDLLHKVLKSPRLFTFSEFHLLKTMLLWVFLQLNYKIQAIPTYETVMTFFKSFPENCCFLDRDIGRSLRPLFLCLRLHGITKGKDLEVLRHLNFFPESWLDQVTVNHYHALENGGDMVHLKDLNTQAVRFGLLFNQENTTYSKTIALYGFFFKIKGLKHDTTSYSFYMQRIKHTDLESPSAVYEHNHVSLRAARLVKYEIRAEALVDGKWQEFRTNQIKQKFGLTTSSCKSHTLKIQTVGIPIYVSFAFIFPAS

SEQ ID NO: 9940 - protein, 478 aa, Homo sapiens
  Payload ID: 1997;
  Gene Symbol: BTBD17;
  Gene Name: BTB (POZ) domain containing 17;
  Uniprot ID:  A6NE02;
  ENSP ID: ENSP00000364515
MPRRGYSKPGSWGSFWAMLTLVGLVTHAAQRADVGGEAAGTSINHSQAVLQRLQELLRQGNASDVVLRVQAAGTDEVRVFHAHRLLLGLHSELFLELLSNQSEAVLQEPQDCAAVFDKFIRYLYCGELTVLLTQAIPLHRLATKYGVSSLQRGVADYMRAHLAGGAGPAVGWYHYAVGTGDEALRESCLQFLAWNLSAVAASTEWGAVSPELLWQLLQRSDLVLQDELELFHALEAWLGRARPPPAVAERALRAIRYPMIPPAQLFQLQARSAALARHGPAVADLLLQAYQFHAASPLHYAKFFDVNGSAFLPRNYLAPAWGAPWVINNPARDDRSTSFQTQLGPSGHDAGRRVTWNVLFSPRWLPVSLRPVYADAAGTALPAARPEDGRPRLVVTPASSGGDAAGVSFQKTVLVGARQQGRLLVRHAYSFHQSSEEAGDFLAHADLQRRNSEYLVENALHLHLIVKPVYHTLIRTPK

SEQ ID NO: 9941 - protein, 712 aa, Homo sapiens
  Payload ID: 1998;
  Gene Symbol: BTBD18;
  Gene Name: BTB (POZ) domain containing 18;
  Uniprot ID:  B2RXH4;
  ENSP ID: ENSP00000394472
MCSPASPKILYRNPRFLRLAFLQLHHQQQSDVFCDVLLQAEGEAVPAHCCILSACSPFFTERLERERPAQGGKVVLELGGLKISTLRKLVDFLYTSEMEVSQEEAQDVLSAARQLRVSELESLQLEGGKLVKAPQGRRLNRECLQPTSAAPISARVVTPSHHPHTPLPTNQTPCPLGAIRLKSLGKEEGPQENNRQNADNLSGTLLLKRKARACPTPQEKNSSPSSHSQEPRENKNDTALDPTVLSPPSLYPSVDKHLLPRKIRLSRSKPSPGICTSKPSSILSGSSSVPATPGRRLWRQRSVNKETPEDKPKPGRASPLQSTPNPSGLGKTGGSRKRSPEVRAPNSDSAEEGQVGRVKLRKIVNGTCWEVVQETPLKNTQDSPQIPDPGGDFQEPSGTQPFSSNEQEMSPTRTELCQDSPMCTKLQDILVSASHSPDHPVVKSEFESSPELVEKEPMLAIDCREPYAFDTALLEQPCEAEEYRITSAAATSELEEILDFMLCGSDIEPPIGSLESPGAEGCRTPTYHLTETGKNWIEGEEWCLPDMELWPRELTELEKEPAGENRGPTELLSPLVMPSEVSEVLSVGGRWTPDLEITSSQPLDGQEDKLLHVSSLDTPQRSYGDLSPPCSNWVETGLEVSLTTDELLYPSPKAGKEVSGHSELLGSLPASSEEEEIDVVDWTAEGRLVPTTVPSVWPDPSSESETEVDILT

SEQ ID NO: 9942 - protein, 712 aa, Homo sapiens; identical to SEQ ID NO: 9941
  Payload ID: 1998;
  Gene Symbol: BTBD18;
  Gene Name: BTB (POZ) domain containing 18;
  Uniprot ID:  B2RXH4;
  ENSP ID: ENSP00000397020

SEQ ID NO: 9943 - protein, 89 aa, Homo sapiens
  Payload ID: 1998;
  Gene Symbol: BTBD18;
  Gene Name: BTB (POZ) domain containing 18;
  ENSP ID: ENSP00000432341
MCSPASPKILYRNPRFLRLAFLQLHHQQQSDVFCDVLLQAEGEAVPAHCCILSACSPFFTERLERERPAQGGKVVLELGGLKISTLRKL

SEQ ID NO: 9944 - protein, 253 aa, Homo sapiens
  Payload ID: 1999;
  Gene Symbol: BTBD19;
  Gene Name: BTB (POZ) domain containing 19;
  ENSP ID: ENSP00000386506
MEPLGLVVHGKAEPFSAALRSLVNNPRYSDVCFVVGQERQEVFAHRCLLACRCNFFQRLLGTEPGPGVPSPVVLSTVPTEAFLAVLEFLYTNSVKLYRHSVAVTFGLGQLQERCVAFIEAHSQEALRTRGFLELSAAALLPLLRSDKLCVDEAELVRAARSWARVGAAVLERPVAEVAAPVVKELRLALLAPAELSALEEQNRQEPLIPVEQIVEAWKCHALRRGDEARGAPCRRRRGTLPREHHRFLDLSFK

SEQ ID NO: 9945 - protein, 291 aa, Homo sapiens
  Payload ID: 1999;
  Gene Symbol: BTBD19;
  Gene Name: BTB (POZ) domain containing 19;
  Uniprot ID:  C9JJ37;
  ENSP ID: ENSP00000395461
MEPLGLVVHGKAEPFSAALRSLVNNPRYSDVCFVVGQERQEVFAHRCLLACRCNFFQRLLGTEPGPGVPSPVVLSTVPTEAFLAVLEFLYTNSVKLYRHSVLEVLTAAVEYGLEELRELCLQFVVKVLDVDLVCEALQVAVTFGLGQLQERCVAFIEAHSQEALRTRGFLELSAAALLPLLRSDKLCVDEAELVRAARSWARVGAAVLERPVAEVAAPVVKELRLALLAPAELSALEEQNRQEPLIPVEQIVEAWKCHALRRGDEARGAPCRRRRGTLPREHHRFLDLSFK

SEQ ID NO: 9946 - protein, 162 aa, Homo sapiens
  Payload ID: 1999;
  Gene Symbol: BTBD19;
  Gene Name: BTB (POZ) domain containing 19;
  Uniprot ID:  C9JJ37;
  ENSP ID: ENSP00000410162
MEPLGLVVHGKAEPFSAALRSLVNNPRYSDVCFVVGQERQEVFAHRCLLACRCNFFQRLLGTEPGPGVPSPVVLSTVPTEAFLAVLEFLYTNSVKLYRHSVLEVLTAAVEYGLEELRELCLQFVVKVLDVDLVCEALQHFWRPRRADQEVRRSRPSWLTRWP

SEQ ID NO: 9947 - protein, 525 aa, Homo sapiens
  Payload ID: 2000;
  Gene Symbol: BTBD2;
  Gene Name: BTB (POZ) domain containing 2;
  Uniprot ID:  Q9BX70;
  ENSP ID: ENSP00000255608
MAAGGSGGRASCPPGVGVGPGTGGSPGPSANAAATPAPGNAAAAAAAAAAAAAAPGPTPPAPPGPGTDAQAAGAERAEEAAGPGAAALQREAAYNWQASKPTVQERFAFLFNNEVLCDVHFLVGKGLSSQRIPAHRFVLAVGSAVFDAMFNGGMATTSTEIELPDVEPAAFLALLKFLYSDEVQIGPETVMTTLYTAKKYAVPALEAHCVEFLKKNLRADNAFMLLTQARLFDEPQLASLCLENIDKNTADAITAEGFTDIDLDTLVAVLERDTLGIREVRLFNAVVRWSEAECQRQQLQVTPENRRKVLGKALGLIRFPLMTIEEFAAGPAQSGILVDREVVSLFLHFTVNPKPRVEFIDRPRCCLRGKECSINRFQQVESRWGYSGTSDRIRFSVNKRIFVVGFGLYGSIHGPTDYQVNIQIIHTDSNTVLGQNDTGFSCDGSASTFRVMFKEPVEVLPNVNYTACATLKGPDSHYGTKGLRKVTHESPTTGAKTCFTFCYAAGNNNGTSVEDGQIPEVIFYT

SEQ ID NO: 9948 - protein, 111 aa, Homo sapiens
  Payload ID: 2000;
  Gene Symbol: BTBD2;
  Gene Name: BTB (POZ) domain containing 2;
  ENSP ID: ENSP00000466686
  MOD_RES (1)..(1): Any amino acid
XLGRRRPPRRAPGQTRRPRARSGRRRRRARGRRRCSARPRTTGRPASPPCRSASPSSSTTRCCATCTSWWARGSARSASPRTGTLPLPPAPLCAKTPRPCSLRPPCCLQTQ

SEQ ID NO: 9949 - protein, 321 aa, Homo sapiens
  Payload ID: 2000;
  Gene Symbol: BTBD2;
  Gene Name: BTB (POZ) domain containing 2;
  ENSP ID: ENSP00000467113
  MOD_RES (1)..(1): Any amino acid
XFNGGMATTSTEIELPDVEPAAFLALLKFLYSDEVQIGPETVMTTLYTAKKYAVPALEAHCVEFLKKNLRADNAFMLLTQAGVQWHDLSSLQPPPPAFKRFSCLSLHSSWDYRPPPPRLAKKKEKKKPERTFSLSLRKCQARLFDEPQLASLCLENIDKNTADAITAEGFTDIDLDTLVAVLERDTLGIREVRLFNAVVRWSEAECQRQQLQVTPENRRKVLGKALGLIRFPLMTIEEFAAGPAQSGILVDREVVSLFLHFTVNPKPRVEFIDRPRCCLRGKECSINRFQQVESRWGYSGTSDRIRFSVNKRIFVVGFGLY

SEQ ID NO: 9950 - protein, 25 aa, Homo sapiens
  Payload ID: 2000;
  Gene Symbol: BTBD2;
  Gene Name: BTB (POZ) domain containing 2;
  ENSP ID: ENSP00000478992
MFNGGMATTSTEIELPDVEPAAFLA

SEQ ID NO: 9951 - protein, 116 aa, Homo sapiens
  Payload ID: 2000;
  Gene Symbol: BTBD2;
  Gene Name: BTB (POZ) domain containing 2;
  ENSP ID: ENSP00000481163
VQCRCPLVRGRVSAAAAAGPAQSGILVDREVVSLFLHFTVNPKPRVEFIDRPRCCLRGKECSINRFQQVESRWGYSGTSDRIRFSVNKRIFVVGFGLYGSIHGPTDYQVNIQIIHT

SEQ ID NO: 9952 - protein, 53 aa, Homo sapiens
  Payload ID: 2000;
  Gene Symbol: BTBD2;
  Gene Name: BTB (POZ) domain containing 2;
  ENSP ID: ENSP00000481529
MFNGGMATTSTEIELPDVEPAAFLALLKFLYSDEVQIGPETVMTTLYTAKKYA

SEQ ID NO: 9953 - protein, 35 aa, Homo sapiens
  Payload ID: 2000;
  Gene Symbol: BTBD2;
  Gene Name: BTB (POZ) domain containing 2;
  ENSP ID: ENSP00000483892
MFNGGMATTSTEIELPDVEPAAFLALLKFLYSDEV

SEQ ID NO: 9954 - protein, 461 aa, Homo sapiens
  Payload ID: 2001;
  Gene Symbol: BTBD3;
  Gene Name: BTB (POZ) domain containing 3;
  Uniprot ID:  Q9Y2F9;
  ENSP ID: ENSP00000254977
MAADIFPRKKPANSSSTSVQQYHQQNLSNNNLIPAPNWQGLYPTIRERNAMMFNNDLMADVHFVVGPPGGTQRLPGHKYVLAVGSSVFHAMFYGELAEDKDEIRIPDVEPAAFLAMLKYIYCDEIDLAADTVLATLYAAKKYIVPHLARACVNFLETSLSAKNACVLLSQSCLFEEPDLTQRCWEVIDAQAELALKSEGFCDIDFQTLESILRRETLNAKEIVVFEAALNWAEVECQRQDLALSIENKRKVLGKALYLIRIPTMALDDFANGAAQSGVLTLNETNDIFLWYTAAKKPELQFVSKARKGLVPQRCHRFQSCAYRSNQWRYRGRCDSIQFAVDKRVFIAGFGLYGSSCGSAEYSAKIELKRQGVVLGQNLSKYFSDGSSNTFPVWFEYPVQIEPDTFYTASVILDGNELSYFGQEGMTEVQCGKVTVQFQCSSDSTNGTGVQGGQIPELIFYA

SEQ ID NO: 9955 - protein, 522 aa, Homo sapiens
  Payload ID: 2001;
  Gene Symbol: BTBD3;
  Gene Name: BTB (POZ) domain containing 3;
  Uniprot ID:  Q9Y2F9;
  ENSP ID: ENSP00000367471
MVDDKEKNMKCLTFFLMLPETVKNRSKKSSKKANTSSSSSNSSKLPPVCYEIITLKTKKKKMAADIFPRKKPANSSSTSVQQYHQQNLSNNNLIPAPNWQGLYPTIRERNAMMFNNDLMADVHFVVGPPGGTQRLPGHKYVLAVGSSVFHAMFYGELAEDKDEIRIPDVEPAAFLAMLKYIYCDEIDLAADTVLATLYAAKKYIVPHLARACVNFLETSLSAKNACVLLSQSCLFEEPDLTQRCWEVIDAQAELALKSEGFCDIDFQTLESILRRETLNAKEIVVFEAALNWAEVECQRQDLALSIENKRKVLGKALYLIRIPTMALDDFANGAAQSGVLTLNETNDIFLWYTAAKKPELQFVSKARKGLVPQRCHRFQSCAYRSNQWRYRGRCDSIQFAVDKRVFIAGFGLYGSSCGSAEYSAKIELKRQGVVLGQNLSKYFSDGSSNTFPVWFEYPVQIEPDTFYTASVILDGNELSYFGQEGMTEVQCGKVTVQFQCSSDSTNGTGVQGGQIPELIFYA

SEQ ID NO: 9956 - protein, 461 aa, Homo sapiens; identical to SEQ ID NO: 9954
  Payload ID: 2001;
  Gene Symbol: BTBD3;
  Gene Name: BTB (POZ) domain containing 3;
  Uniprot ID:  Q9Y2F9;
  ENSP ID: ENSP00000381971

SEQ ID NO: 9957 - protein, 522 aa, Homo sapiens; identical to SEQ ID NO: 9955
  Payload ID: 2001;
  Gene Symbol: BTBD3;
  Gene Name: BTB (POZ) domain containing 3;
  Uniprot ID:  Q9Y2F9;
  ENSP ID: ENSP00000384545

SEQ ID NO: 9958 - protein, 135 aa, Homo sapiens
  Payload ID: 2001;
  Gene Symbol: BTBD3;
  Gene Name: BTB (POZ) domain containing 3;
  ENSP ID: ENSP00000397809
MAADIFPRKKPANSSSTSVQQYHQQNLSNNNLIPAPNWQGLYPTIRERNAMMFNNDLMADVHFVVGPPGGTQRLPGHKYVLAVGSSVFHAMFYGELAEDKDEIRIPDVEPAAFLAMLKYIYCDEIDLAADTVLAT

SEQ ID NO: 9959 - protein, 1 aa, Homo sapiens
  Payload ID: 2001;
  Gene Symbol: BTBD3;
  Gene Name: BTB (POZ) domain containing 3;
  ENSP ID: ENSP00000404268
M

SEQ ID NO: 9960 - protein, 99 aa, Homo sapiens
  Payload ID: 2001;
  Gene Symbol: BTBD3;
  Gene Name: BTB (POZ) domain containing 3;
  ENSP ID: ENSP00000404582
MMFNNDLMADVHFVVGPPGGTQRLPGHKYVLAVGSSVFHAMFYGELAEDKDEIRIPDVEPAAFLAMLKYIYCDEIDLAADTVLATLYAAKKYIVPHLAR

SEQ ID NO: 9961 - protein, 139 aa, Homo sapiens
  Payload ID: 2001;
  Gene Symbol: BTBD3;
  Gene Name: BTB (POZ) domain containing 3;
  ENSP ID: ENSP00000408817
MMFNNDLMADVHFVVGPPGGTQRLPGHKYVLAVGSSVFHAMFYGELAEDKDEIRIPDVEPAAFLAMLKYIYCDEIDLAADTVLATLYAAKKYIVPHLARACVNFLETSLSAKNACVLLSQSCLFEEPDLTQRCWEVIDA

SEQ ID NO: 9962 - protein, 50 aa, Homo sapiens
  Payload ID: 2001;
  Gene Symbol: BTBD3;
  Gene Name: BTB (POZ) domain containing 3;
  ENSP ID: ENSP00000410502
MAADIFPRKKPANSSSTSVQQYHQQNLSNNNLIPAPNWQGLYPTIRESMF

SEQ ID NO: 9963 - protein, 461 aa, Homo sapiens; identical to SEQ ID NO: 9954
  Payload ID: 2001;
  Gene Symbol: BTBD3;
  Gene Name: BTB (POZ) domain containing 3;
  Uniprot ID:  Q9Y2F9;
  ENSP ID: ENSP00000477589

SEQ ID NO: 9964 - protein, 461 aa, Homo sapiens; identical to SEQ ID NO: 9954
  Payload ID: 2001;
  Gene Symbol: BTBD3;
  Gene Name: BTB (POZ) domain containing 3;
  Uniprot ID:  Q9Y2F9;
  ENSP ID: ENSP00000483520

SEQ ID NO: 9965 - protein, 410 aa, Homo sapiens
  Payload ID: 2002;
  Gene Symbol: BTBD6;
  Gene Name: BTB (POZ) domain containing 6;
  Uniprot ID:  Q96KE9;
  ENSP ID: ENSP00000329361
MFNNELMADVHFVVGPPGATRTVPAHKYVLAVGSSVFYAMFYGDLAEVKSEIHIPDVEPAAFLILLKYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMSDGSSNTFPVWFEHPVQVEQDTFYTASAVLDGSELSYFGQEGMTEVQCGKVAFQFQCSSDSTNGTGVQGGQIPELIFYA

SEQ ID NO: 9966 - protein, 485 aa, Homo sapiens
  Payload ID: 2002;
  Gene Symbol: BTBD6;
  Gene Name: BTB (POZ) domain containing 6;
  Uniprot ID:  Q96KE9;
  ENSP ID: ENSP00000376337
MAAELYAPASAAAADLANSNAGAAVGRKAGPRSPPSAPAPAPPPPAPAPPTLGNNHQESPGWRCCRPTLRERNALMFNNELMADVHFVVGPPGATRTVPAHKYVLAVGSSVFYAMFYGDLAEVKSEIHIPDVEPAAFLILLKYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMSDGSSNTFPVWFEHPVQVEQDTFYTASAVLDGSELSYFGQEGMTEVQCGKVAFQFQCSSDSTNGTGVQGGQIPELIFYA

SEQ ID NO: 9967 - protein, 410 aa, Homo sapiens; identical to SEQ ID NO: 9965
  Payload ID: 2002;
  Gene Symbol: BTBD6;
  Gene Name: BTB (POZ) domain containing 6;
  Uniprot ID:  Q96KE9;
  ENSP ID: ENSP00000418150

SEQ ID NO: 9968 - protein, 485 aa, Homo sapiens; identical to SEQ ID NO: 9966
  Payload ID: 2002;
  Gene Symbol: BTBD6;
  Gene Name: BTB (POZ) domain containing 6;
  Uniprot ID:  Q96KE9;
  ENSP ID: ENSP00000443091

SEQ ID NO: 9969 - protein, 407 aa, Homo sapiens
  Payload ID: 2002;
  Gene Symbol: BTBD6;
  Gene Name: BTB (POZ) domain containing 6;
  ENSP ID: ENSP00000446223
MAAELYAPASAAAADLANSNAGAAVGRKAGPRSPPSAPAPAPPPPAPAPPTLGNNHQESPGWRCCRPTLRERNALMFNNELMADVHFVVGPPGATRTVPAHKYVLAVGSSVFYAMFYGDLAEVKSEIHIPDVEPAAFLILLKYMYSDEIDLEADTVLATLYAAKKYIVPALAKACVNFLETSLEAKNACVLLSQSRLFEEPELTQRCWEVIDAQAEMALRSEGFCEIDRQTLEIIVTREALNTKEAVVFEAVLNWAEAECKRQGLPITPRNKRHVLGRALYLVRIPTMTLEEFANGAAQSDILTLEETHSIFLWYTATNKPRLDFPLTKRKGLAPQRCHRFQSSAYRSNQWRYRGRCDSIQFAVDRRVFIAGLGLYGSSSGKAEYSVKIELKRLGVVLAQNLTKFMS

SEQ ID NO: 9970 - protein, 410 aa, Homo sapiens
  Payload ID: 2003;
  Gene Symbol: BTBD7;
  Gene Name: BTB (POZ) domain containing 7;
  Uniprot ID:  Q9P203;
  ENSP ID: ENSP00000298896
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQEETTVIRPACAAELSNSCLLPQS

SEQ ID NO: 9971 - protein, 1132 aa, Homo sapiens
  Payload ID: 2003;
  Gene Symbol: BTBD7;
  Gene Name: BTB (POZ) domain containing 7;
  Uniprot ID:  Q9P203;
  ENSP ID: ENSP00000335615
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQGCEDIIAESISLDTLIAILKWSSHPYGSKWVHRQALHFLCEEFSQVMTSDVFYELSKDHLLTAIQSDYLQASEQDILKYLIKWGEHQLMKRIADREPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 9972 - protein, 26 aa, Homo sapiens
  Payload ID: 2003;
  Gene Symbol: BTBD7;
  Gene Name: BTB (POZ) domain containing 7;
  ENSP ID: ENSP00000347246
  MOD_RES (1)..(1): Any amino acid
XTRAEEAMELYHIALFLEFNMLAQGK

SEQ ID NO: 9973 - protein, 55 aa, Homo sapiens
  Payload ID: 2003;
  Gene Symbol: BTBD7;
  Gene Name: BTB (POZ) domain containing 7;
  ENSP ID: ENSP00000450704
MGANASNYPHSCSPRVGGNSQAQQTFIGTSSYSQQGYGCESKLYSLDHGHEKPQD

SEQ ID NO: 9974 - protein, 747 aa, Homo sapiens
  Payload ID: 2003;
  Gene Symbol: BTBD7;
  Gene Name: BTB (POZ) domain containing 7;
  ENSP ID: ENSP00000450778
LLQRRIRTGEEITDRTLRTPTRIILDESIIPKKYATVILHCMYTDVVDLSVLHCSPSVGSLSEVQALVAGKPNMTRAEEAMELYHIALFLEFNMLAQEPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 9975 - protein, 781 aa, Homo sapiens
  Payload ID: 2003;
  Gene Symbol: BTBD7;
  Gene Name: BTB (POZ) domain containing 7;
  Uniprot ID:  Q9P203;
  ENSP ID: ENSP00000451010
MAGGAGAGADGGAGGGGGGGDGSGPSGSSSGGRSLRGCEDIIAESISLDTLIAILKWSSHPYGSKWVHRQALHFLCEEFSQVMTSDVFYELSKDHLLTAIQSDYLQASEQDILKYLIKWGEHQLMKRIADREPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 9976 - protein, 478 aa, Homo sapiens
  Payload ID: 2003;
  Gene Symbol: BTBD7;
  Gene Name: BTB (POZ) domain containing 7;
  ENSP ID: ENSP00000451408
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQACLPFVLQRRLQSSGLPVQQSFQTAAYCLNLKYENPSKDNWTFEESFQIETEIRAKRTKSWRKQTMKGAEENFSRIKISLYKRTFYGISET

SEQ ID NO: 9977 - protein, 26 aa, Homo sapiens
  Payload ID: 2003;
  Gene Symbol: BTBD7;
  Gene Name: BTB (POZ) domain containing 7;
  ENSP ID: ENSP00000478856
  MOD_RES (1)..(1): Any amino acid
XTRAEEAMELYHIALFLEFNMLAQGK

SEQ ID NO: 9978 - protein, 1132 aa, Homo sapiens; identical to SEQ ID NO: 9971
  Payload ID: 2003;
  Gene Symbol: BTBD7;
  Gene Name: BTB (POZ) domain containing 7;
  Uniprot ID:  Q9P203;
  ENSP ID: ENSP00000479193

SEQ ID NO: 9979 - protein, 410 aa, Homo sapiens; identical to SEQ ID NO: 9970
  Payload ID: 2003;
  Gene Symbol: BTBD7;
  Gene Name: BTB (POZ) domain containing 7;
  Uniprot ID:  Q9P203;
  ENSP ID: ENSP00000481899

SEQ ID NO: 9980 - protein, 747 aa, Homo sapiens; identical to SEQ ID NO: 9974
  Payload ID: 2003;
  Gene Symbol: BTBD7;
  Gene Name: BTB (POZ) domain containing 7;
  ENSP ID: ENSP00000486038

SEQ ID NO: 9981 - protein, 781 aa, Homo sapiens; identical to SEQ ID NO: 9975
  Payload ID: 2003;
  Gene Symbol: BTBD7;
  Gene Name: BTB (POZ) domain containing 7;
  Uniprot ID:  Q9P203;
  ENSP ID: ENSP00000486274

SEQ ID NO: 9982 - protein, 55 aa, Homo sapiens; identical to SEQ ID NO: 9973
  Payload ID: 2003;
  Gene Symbol: BTBD7;
  Gene Name: BTB (POZ) domain containing 7;
  ENSP ID: ENSP00000486412

SEQ ID NO: 9983 - protein, 478 aa, Homo sapiens; identical to SEQ ID NO: 9976
  Payload ID: 2003;
  Gene Symbol: BTBD7;
  Gene Name: BTB (POZ) domain containing 7;
  ENSP ID: ENSP00000486521

SEQ ID NO: 9984 - protein, 378 aa, Homo sapiens
  Payload ID: 2004;
  Gene Symbol: BTBD8;
  Gene Name: BTB (POZ) domain containing 8;
  Uniprot ID:  Q5XKL5;
  ENSP ID: ENSP00000343686
MARCGEGSAAPMVLLGSAGVCSKGLQRKGPCERRRLKATVSEQLSQDLLRLLREEFHTDVTFSVGCTLFKAHKAVLLARVPDFYFHTIGQTSNSLTNQEPIAVENVEALEFRTFLQIIYSSNRNIKNYEEEILRKKIMEIGISQKQLDISFPKCENSSDCSLQKHEIPEDISDRDDDFISNDNYDLEPASELGEDLLKLYVKPCCPDIDIFVDGKRFKAHRAILSARSSYFAAMLSGCWAESSQEYVTLQGISHVELNVMMHFIYGGTLDIPDKTNVGQILNMADMYGLEGLKEVAIYILRRDYCNFFQKPVPRTLTSILECLIIAHSVGVESLFADCMKWIVKHFARFWSERSFANIPPEIQKSCLNMLIQSLVSIT

SEQ ID NO: 9985 - protein, 305 aa, Homo sapiens
  Payload ID: 2004;
  Gene Symbol: BTBD8;
  Gene Name: BTB (POZ) domain containing 8;
  Uniprot ID:  Q5XKL5;
  ENSP ID: ENSP00000359408
MARCGEGSAAPMVLLGSAGVCSKGLQRKGPCERRRLKATVSEQLSQDLLRLLREEFHTDVTFSVGCTLFKAHKAVLLARVPDFYFHTIGQTSNSLTNQEPIAVENVEALEFRTFLQIIYSSNRNIKNYEEEILRKKIMEIGISQKQLDISFPKCENSSDCSLQKHEIPEDISDRDDDFISNDNYDLEPASELGEDLLKLYVKPCCPDIDIFVDGKRFKAHRAILSARSSYFAAMLSGCWAESSQEYVTLQGISHVELNVMMHFIYGGTLDIPDKTNVGYVFLFNNLKYKRVRFCFVELCCKVLMK

SEQ ID NO: 9986 - protein, 544 aa, Homo sapiens
  Payload ID: 2005;
  Gene Symbol: BTBD9;
  Gene Name: BTB (POZ) domain containing 9;
  Uniprot ID:  Q96Q07;
  ENSP ID: ENSP00000323408
MRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSHALRAPSGSSLPSSPGSNSRSPNRQHQ

SEQ ID NO: 9987 - protein, 318 aa, Homo sapiens
  Payload ID: 2005;
  Gene Symbol: BTBD9;
  Gene Name: BTB (POZ) domain containing 9;
  ENSP ID: ENSP00000328328
MRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCSL

SEQ ID NO: 9988 - protein, 385 aa, Homo sapiens
  Payload ID: 2005;
  Gene Symbol: BTBD9;
  Gene Name: BTB (POZ) domain containing 9;
  ENSP ID: ENSP00000386121
MSNSHPLRPFTAVGEIDHVHILSEHIGALLIGEEYGDVTFVVEKKRFPAHRVILAARCQYFRALLYGGMRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCR

SEQ ID NO: 9989 - protein, 354 aa, Homo sapiens
  Payload ID: 2005;
  Gene Symbol: BTBD9;
  Gene Name: BTB (POZ) domain containing 9;
  ENSP ID: ENSP00000386211
MCRALLYGGMRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCSRDGALPCCPGWSSTPGLKRSDCFSLTKC

SEQ ID NO: 9990 - protein, 582 aa, Homo sapiens
  Payload ID: 2005;
  Gene Symbol: BTBD9;
  Gene Name: BTB (POZ) domain containing 9;
  Uniprot ID:  Q96Q07;
  ENSP ID: ENSP00000415365
MCRALLYGGMRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCSGDGVSLWCPLWSRTPELKQSSLLGLPKCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSHALRAPSGSSLPSSPGSNSRSPNRQHQ

SEQ ID NO: 9991 - protein, 115 aa, Homo sapiens
  Payload ID: 2005;
  Gene Symbol: BTBD9;
  Gene Name: BTB (POZ) domain containing 9;
  ENSP ID: ENSP00000418201
MRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSK

SEQ ID NO: 9992 - protein, 612 aa, Homo sapiens
  Payload ID: 2005;
  Gene Symbol: BTBD9;
  Gene Name: BTB (POZ) domain containing 9;
  Uniprot ID:  Q96Q07;
  ENSP ID: ENSP00000418751
MSNSHPLRPFTAVGEIDHVHILSEHIGALLIGEEYGDVTFVVEKKRFPAHRVILAARCQYFRALLYGGMRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSIINHIRILLWDRDSRSYSYFIEVSMDELDWVRVIDHSQYLCRSWQKLYFPARVCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSHALRAPSGSSLPSSPGSNSRSPNRQHQ

SEQ ID NO: 9993 - protein, 92 aa, Homo sapiens
  Payload ID: 2005;
  Gene Symbol: BTBD9;
  Gene Name: BTB (POZ) domain containing 9;
  ENSP ID: ENSP00000419382
MSNSHPLRPFTAVGEIDHVHILSEHIGALLIGEEYGDVTFVVEKKRFPAHRVILAARCQYFRALLYGGMRESQPEAEIPLQDTTAEAFTMLL

SEQ ID NO: 9994 - protein, 736 aa, Homo sapiens
  Payload ID: 2006;
  Gene Symbol: BACH1;
  Gene Name: BTB and CNC homology 1, basic leu zipper transcription factor 1;
  Uniprot ID:  O14867;
  ENSP ID: ENSP00000286800
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQPNERSENECLGGVPECRDLQVMLKCDESKLAMEPEETKKDPASQCPTEKSEVTPFPHNSSIDPHGLYSLSLLHTYDQYGDLNFAGMQNTTVLTEKPLSGTDVQEKTFGESQDLPLKSDLGTREDSSVASSDRSSVEREVAEHLAKGFWSDICSTDTPCQMQLSPAVAKDGSEQISQKRSECPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLQSEKESLLKERDHILSTLGETKQNLTGLCQKVCKEAALSQEQIQILAKYSAADCPLSFLISEKDKSTPDGELALPSIFSLSDRPPAVLPPCARGNSEPGYARGQESQQMSTATSEQAGPAEQCRQSGGISDFCQQMTDKCTTDE

SEQ ID NO: 9995 - protein, 736 aa, Homo sapiens; identical to SEQ ID NO: 9994
  Payload ID: 2006;
  Gene Symbol: BACH1;
  Gene Name: BTB and CNC homology 1, basic leu zipper transcription factor 1;
  Uniprot ID:  O14867;
  ENSP ID: ENSP00000382805

SEQ ID NO: 9996 - protein, 170 aa, Homo sapiens
  Payload ID: 2006;
  Gene Symbol: BACH1;
  Gene Name: BTB and CNC homology 1, basic leu zipper transcription factor 1;
  ENSP ID: ENSP00000392202
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEV

SEQ ID NO: 9997 - protein, 224 aa, Homo sapiens
  Payload ID: 2006;
  Gene Symbol: BACH1;
  Gene Name: BTB and CNC homology 1, basic leu zipper transcription factor 1;
  ENSP ID: ENSP00000400576
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLC

SEQ ID NO: 9998 - protein, 220 aa, Homo sapiens
  Payload ID: 2006;
  Gene Symbol: BACH1;
  Gene Name: BTB and CNC homology 1, basic leu zipper transcription factor 1;
  ENSP ID: ENSP00000408605
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALAL

SEQ ID NO: 9999 - protein, 218 aa, Homo sapiens
  Payload ID: 2006;
  Gene Symbol: BACH1;
  Gene Name: BTB and CNC homology 1, basic leu zipper transcription factor 1;
  ENSP ID: ENSP00000416569
  MOD_RES (1)..(1): Any amino acid
XPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLNHGLWSLNQQPWFANIPCTIVETGWMPCALSGHVRPTEGQIRVKRKPEDGRDIFEGTSCQ

SEQ ID NO: 10000 - protein, 25 aa, Homo sapiens
  Payload ID: 2006;
  Gene Symbol: BACH1;
  Gene Name: BTB and CNC homology 1, basic leu zipper transcription factor 1;
  ENSP ID: ENSP00000447332
MSLSENSVFAYESSVHSTNVLLSLN

SEQ ID NO: 10001 - protein, 25 aa, Homo sapiens
  Payload ID: 2006;
  Gene Symbol: BACH1;
  Gene Name: BTB and CNC homology 1, basic leu zipper transcription factor 1;
  ENSP ID: ENSP00000448663
MSLSENSVFAYESSVHSTNVLLSLN

SEQ ID NO: 10002 - protein, 25 aa, Homo sapiens
  Payload ID: 2006;
  Gene Symbol: BACH1;
  Gene Name: BTB and CNC homology 1, basic leu zipper transcription factor 1;
  ENSP ID: ENSP00000448982
MSLSENSVFAYESSVHSTNVLLSLN

SEQ ID NO: 10003 - protein, 25 aa, Homo sapiens
  Payload ID: 2006;
  Gene Symbol: BACH1;
  Gene Name: BTB and CNC homology 1, basic leu zipper transcription factor 1;
  ENSP ID: ENSP00000449316
MSLSENSVFAYESSVHSTNVLLSLN

SEQ ID NO: 10004 - protein, 25 aa, Homo sapiens
  Payload ID: 2006;
  Gene Symbol: BACH1;
  Gene Name: BTB and CNC homology 1, basic leu zipper transcription factor 1;
  ENSP ID: ENSP00000449383
MSLSENSVFAYESSVHSTNVLLSLN

SEQ ID NO: 10005 - protein, 138 aa, Homo sapiens
  Payload ID: 2006;
  Gene Symbol: BACH1;
  Gene Name: BTB and CNC homology 1, basic leu zipper transcription factor 1;
  ENSP ID: ENSP00000470673
  MOD_RES (1)..(1): Any amino acid
XSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLPTSHAPSWRLAGCPVLYQGMSDQQRGKSE

SEQ ID NO: 10006 - protein, 841 aa, Homo sapiens
  Payload ID: 2007;
  Gene Symbol: BACH2;
  Gene Name: BTB and CNC homology 1, basic leu zipper transcription factor 2;
  Uniprot ID:  Q9BYV9;
  ENSP ID: ENSP00000257749
MSVDEKPDSPMYVYESTVHCTNILLGLNDQRKKDILCDVTLIVERKEFRAHRAVLAACSEYFWQALVGQTKNDLVVSLPEEVTARGFGPLLQFAYTAKLLLSRENIREVIRCAEFLRMHNLEDSCFSFLQTQLLNSEDGLFVCRKDAACQRPHEDCENSAGEEEDEEEETMDSETAKMACPRDQMLPEPISFEAAAIPVAEKEEALLPEPDVPTDTKESSEKDALTQYPRYKKYQLACTKNVYNASSHSTSGFASTFREDNSSNSLKPGLARGQIKSEPPSEENEEESITLCLSGDEPDAKDRAGDVEMDRKQPSPAPTPTAPAGAACLERSRSVASPSCLRSLFSITKSVELSGLPSTSQQHFARSPACPFDKGITQGDLKTDYTPFTGNYGQPHVGQKEVSNFTMGSPLRGPGLEALCKQEGELDRRSVIFSSSACDQVSTSVHSYSGVSSLDKDLSEPVPKGLWVGAGQSLPSSQAYSHGGLMADHLPGRMRPNTSCPVPIKVCPRSPPLETRTRTSSSCSSYSYAEDGSGGSPCSLPLCEFSSSPCSQGARFLATEHQEPGLMGDGMYNQVRPQIKCEQSYGTNSSDESGSFSEADSESCPVQDRGQEVKLPFPVDQITDLPRNDFQMMIKMHKLTSEQLEFIHDVRRRSKNRIAAQRCRKRKLDCIQNLECEIRKLVCEKEKLLSERNQLKACMGELLDNFSCLSQEVCRDIQSPEQIQALHRYCPVLRPMDLPTASSINPAPLGAEQNIAASQCAVGENVPCCLEPGAAPPGPPWAPSNTSENCTSGRRLEGTDPGTFSERGPPLEPRSQTVTVDFCQEMTDKCTTDEQPRKDYT

SEQ ID NO: 10007 - protein, 841 aa, Homo sapiens; identical to SEQ ID NO: 10006
  Payload ID: 2007;
  Gene Symbol: BACH2;
  Gene Name: BTB and CNC homology 1, basic leu zipper transcription factor 2;
  Uniprot ID:  Q9BYV9;
  ENSP ID: ENSP00000345642

SEQ ID NO: 10008 - protein, 81 aa, Homo sapiens
  Payload ID: 2007;
  Gene Symbol: BACH2;
  Gene Name: BTB and CNC homology 1, basic leu zipper transcription factor 2;
  ENSP ID: ENSP00000384145
MSVDEKPDSPMYVYESTVHCTNILLGLNDQRKKDILCDVTLIVERKEFRAHRAVLAACSEYFWQALVGQTKNDLVVSLPEE

SEQ ID NO: 10009 - protein, 81 aa, Homo sapiens; identical to SEQ ID NO: 10008
  Payload ID: 2007;
  Gene Symbol: BACH2;
  Gene Name: BTB and CNC homology 1, basic leu zipper transcription factor 2;
  ENSP ID: ENSP00000397668

SEQ ID NO: 10010 - protein, 841 aa, Homo sapiens; identical to SEQ ID NO: 10006
  Payload ID: 2007;
  Gene Symbol: BACH2;
  Gene Name: BTB and CNC homology 1, basic leu zipper transcription factor 2;
  Uniprot ID:  Q9BYV9;
  ENSP ID: ENSP00000437473

SEQ ID NO: 10011 - protein, 158 aa, Homo sapiens
  Payload ID: 2008;
  Gene Symbol: BTG2;
  Gene Name: BTG family, member 2;
  Uniprot ID:  P78543;
  ENSP ID: ENSP00000290551
MSHGKGTDMLPEIAAAVGFLSSLLRTRGCVSEQRLKVFSGALQEALTEHYKHHWFPEKPSKGSGYRCIRINHKMDPIISRVASQIGLSQPQLHQLLPSELTLWVDPYEVSYRIGEDGSICVLYEEAPLAASCGLLTCKNQVLLGRSSPSKNYVMAVSS

SEQ ID NO: 10012 - protein, 158 aa, Homo sapiens; identical to SEQ ID NO: 10011
  Payload ID: 2008;
  Gene Symbol: BTG2;
  Gene Name: BTG family, member 2;
  Uniprot ID:  P78543;
  ENSP ID: ENSP00000433553

SEQ ID NO: 10013 - protein, 252 aa, Homo sapiens
  Payload ID: 2009;
  Gene Symbol: BTG3;
  Gene Name: BTG family, member 3;
  Uniprot ID:  Q14201;
  ENSP ID: ENSP00000284879
MKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRYGEKNNAFIVASFENKDENKDEISRKVTRALDKVTSDYHSGSSSSDEETSKEMEVKPSSVTAAASPVYQISELIFPPLPMWHPLPRKKPGMYRGNGHQNHYPPPVPFGYPNQGRKNKPYRPIPVTWVPPPGMHCDRNHWINPHMLAPH

SEQ ID NO: 10014 - protein, 296 aa, Homo sapiens
  Payload ID: 2009;
  Gene Symbol: BTG3;
  Gene Name: BTG family, member 3;
  Uniprot ID:  Q14201;
  ENSP ID: ENSP00000344609
MKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRRDGVSPCWPDCSQTPDLVIRPPWPPKALDYRREPLRPASSFLIMYGEKNNAFIVASFENKDENKDEISRKVTRALDKVTSDYHSGSSSSDEETSKEMEVKPSSVTAAASPVYQISELIFPPLPMWHPLPRKKPGMYRGNGHQNHYPPPVPFGYPNQGRKNKPYRPIPVTWVPPPGMHCDRNHWINPHMLAPH

SEQ ID NO: 10015 - protein, 46 aa, Homo sapiens
  Payload ID: 2009;
  Gene Symbol: BTG3;
  Gene Name: BTG family, member 3;
  ENSP ID: ENSP00000413799
MKNEIAAVVFFFTRLVRKHDKLKKEAVERFAEKLTLILQEKYKNHW

SEQ ID NO: 10016 - protein, 46 aa, Homo sapiens; identical to SEQ ID NO: 10015
  Payload ID: 2009;
  Gene Symbol: BTG3;
  Gene Name: BTG family, member 3;
  ENSP ID: ENSP00000486833

SEQ ID NO: 10017 - protein, 147 aa, Homo sapiens
  Payload ID: 2009;
  Gene Symbol: BTG3;
  Gene Name: BTG family, member 3;
  ENSP ID: ENSP00000487035
MKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCCRRDGVSPCWPDCSQTPDLVIRPPWPPKALDYRREPLRPASSFLI

SEQ ID NO: 10018 - protein, 103 aa, Homo sapiens
  Payload ID: 2009;
  Gene Symbol: BTG3;
  Gene Name: BTG family, member 3;
  ENSP ID: ENSP00000487043
MKNEIAAVVFFFTRLVRKHDKLKKEAVERFAEKLTLILQEKYKNHWYPEKPSKGQAYRCIRVNKFQRVDPDVLKACENSCILYSDLGLPKELTLWVDPCEVCC

SEQ ID NO: 10019 - protein, 519 aa, Homo sapiens
  Payload ID: 2010;
  Gene Symbol: BANP;
  Gene Name: BTG3 associated nuclear prt;
  Uniprot ID:  Q8N9N5;
  ENSP ID: ENSP00000286122
MMSEHDLADVVQIAVEDLSPDHPVVLENHVVTDEDEPALKRQRLEINCQDPSIKTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVGHLHIAQVPQGEQVQITQDSEGNLQIHHVGQDGQLLEATRIPCLLAPSVFKASSGQVLQGAQLIAVASSDPAAAGVDGSPLQGSDIQVQYVQLAPVSDHTAGAQTAEALQPTLQPEMQLEHGAIQIQ

SEQ ID NO: 10020 - protein, 469 aa, Homo sapiens
  Payload ID: 2010;
  Gene Symbol: BANP;
  Gene Name: BTG3 associated nuclear prt;
  Uniprot ID:  Q8N9N5;
  ENSP ID: ENSP00000347125
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQVLQGAQLIAVASSDPAAAGVDGSPLQGSDIQVQYVQLAPVSDHTAGAQTAEALQPTLQPEMQLEHGAIQIQ

SEQ ID NO: 10021 - protein, 250 aa, Homo sapiens
  Payload ID: 2010;
  Gene Symbol: BANP;
  Gene Name: BTG3 associated nuclear prt;
  ENSP ID: ENSP00000347290
MGSPEPTQGPRLSPILIPYSGRRYKVGRASGALCHQDSLPPILELGLTFLRASAGFSVPTSSSFALPEPLRSLCLGNGEGLGLSLTLTVLAWILGLSGTLGALVLFMVATGIFQEALWHLLLLSFSVEALPCFFFFPFFLLCRCLRAELQIQQRLDGTLSLDLMRLESDGETGCAAESSVLQGAQLIAVASSDPAAAGVDGSPLQGSDIQVQYVQLAPVSDHTAGAQTAEALQPTLQPEMQLEHGAIQIQ

SEQ ID NO: 10022 - protein, 519 aa, Homo sapiens; identical to SEQ ID NO: 10019
  Payload ID: 2010;
  Gene Symbol: BANP;
  Gene Name: BTG3 associated nuclear prt;
  Uniprot ID:  Q8N9N5;
  ENSP ID: ENSP00000376902

SEQ ID NO: 10023 - protein, 491 aa, Homo sapiens
  Payload ID: 2010;
  Gene Symbol: BANP;
  Gene Name: BTG3 associated nuclear prt;
  Uniprot ID:  Q8N9N5;
  ENSP ID: ENSP00000376903
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQLLEATRIPCLLAPSVFKASSGQVLQGAQLIAVASSDPAAAGVDGSPLQGSDIQVQYVQLAPVSDHTAGAQTAEALQPTLQPEMQLEHGAIQIQ

SEQ ID NO: 10024 - protein, 118 aa, Homo sapiens
  Payload ID: 2010;
  Gene Symbol: BANP;
  Gene Name: BTG3 associated nuclear prt;
  ENSP ID: ENSP00000390504
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNK

SEQ ID NO: 10025 - protein, 123 aa, Homo sapiens
  Payload ID: 2010;
  Gene Symbol: BANP;
  Gene Name: BTG3 associated nuclear prt;
  ENSP ID: ENSP00000399576
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCVV

SEQ ID NO: 10026 - protein, 95 aa, Homo sapiens
  Payload ID: 2010;
  Gene Symbol: BANP;
  Gene Name: BTG3 associated nuclear prt;
  ENSP ID: ENSP00000401454
MMSEHDLADVVQIAVEDLSPDHPVVLENHVVTDEDEPALKRQRLEINCQDPSIKSFLYSINQTICLRLDSIEAKLQALEATCKSLEEKLDLVTNK

SEQ ID NO: 10027 - protein, 28 aa, Homo sapiens
  Payload ID: 2010;
  Gene Symbol: BANP;
  Gene Name: BTG3 associated nuclear prt;
  ENSP ID: ENSP00000401718
MMSEHDLADVVQIAVEDLSPDHPVVLEN

SEQ ID NO: 10028 - protein, 119 aa, Homo sapiens
  Payload ID: 2010;
  Gene Symbol: BANP;
  Gene Name: BTG3 associated nuclear prt;
  ENSP ID: ENSP00000410089
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKV

SEQ ID NO: 10029 - protein, 194 aa, Homo sapiens
  Payload ID: 2010;
  Gene Symbol: BANP;
  Gene Name: BTG3 associated nuclear prt;
  ENSP ID: ENSP00000411479
MMSEHDLADVVQIAVEDLSPDHPGTELWDIVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWL

SEQ ID NO: 10030 - protein, 56 aa, Homo sapiens
  Payload ID: 2010;
  Gene Symbol: BANP;
  Gene Name: BTG3 associated nuclear prt;
  ENSP ID: ENSP00000413717
MRSLPVRSHEAEGIAVCCTQGTPAPQPLSSWDYPVVLENHVVTDEDEPALKRQRLE

SEQ ID NO: 10031 - protein, 128 aa, Homo sapiens
  Payload ID: 2010;
  Gene Symbol: BANP;
  Gene Name: BTG3 associated nuclear prt;
  ENSP ID: ENSP00000431812
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCLPQQSGP

SEQ ID NO: 10032 - protein, 466 aa, Homo sapiens
  Payload ID: 2010;
  Gene Symbol: BANP;
  Gene Name: BTG3 associated nuclear prt;
  Uniprot ID:  Q8N9N5;
  ENSP ID: ENSP00000432508
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVGHLHIAQVPQGEQVQITQDSEGNLQIHHVGQDGQVLQGAQLIAVASSDPAAAGVDGSPLQGSDIQVQYVQLAPVSDHTAGAQTAEALQPTLQPEMQLEHGAIQIQ

SEQ ID NO: 10033 - protein, 40 aa, Homo sapiens
  Payload ID: 2010;
  Gene Symbol: BANP;
  Gene Name: BTG3 associated nuclear prt;
  ENSP ID: ENSP00000435727
MMSEHDLADVVQIAVEDLSPDHPGTELWDSSCFGESCSDR

SEQ ID NO: 10034 - protein, 40 aa, Homo sapiens; identical to SEQ ID NO: 10033
  Payload ID: 2010;
  Gene Symbol: BANP;
  Gene Name: BTG3 associated nuclear prt;
  ENSP ID: ENSP00000436869

SEQ ID NO: 10035 - protein, 508 aa, Homo sapiens
  Payload ID: 2010;
  Gene Symbol: BANP;
  Gene Name: BTG3 associated nuclear prt;
  Uniprot ID:  Q8N9N5;
  ENSP ID: ENSP00000444352
MMSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQVLQGAQLIAVASSDPAAAGVDGSPLQGSDIQVQYVQLAPVSDHTAGAQTAEALQPTLQPEMQLEHGAIQIQ

SEQ ID NO: 10036 - protein, 497 aa, Homo sapiens
  Payload ID: 2010;
  Gene Symbol: BANP;
  Gene Name: BTG3 associated nuclear prt;
  Uniprot ID:  Q8N9N5;
  ENSP ID: ENSP00000487304
MMSEHDLADVVQIAVEDLSPDHPGTELWDIVLENHVVTDEDEPALKRQRLEINCQDPSIKSFLYSINQTICLRLDSIEAKLQALEATCKSLEEKLDLVTNKQHSPIQVPMVAGSPLGATQTCNKVRCAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQLLEATRIPCLLAPSVFKASSGQVLQGAQLIAVASSDPAAAGVDGSPLQGSDIQVQYVQLAPVSDHTAGAQTAEALQPTLQPEMQLEHGAIQIQ

SEQ ID NO: 10037 - protein, 1085 aa, Homo sapiens
  Payload ID: 2011;
  Gene Symbol: BUB1;
  Gene Name: BUB1 mitotic checkpoint serine/threonine kinase;
  Uniprot ID:  O43683;
  ENSP ID: ENSP00000302530
MDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 10038 - protein, 1028 aa, Homo sapiens
  Payload ID: 2011;
  Gene Symbol: BUB1;
  Gene Name: BUB1 mitotic checkpoint serine/threonine kinase;
  Uniprot ID:  O43683;
  ENSP ID: ENSP00000386701
MDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 10039 - protein, 56 aa, Homo sapiens
  Payload ID: 2011;
  Gene Symbol: BUB1;
  Gene Name: BUB1 mitotic checkpoint serine/threonine kinase;
  ENSP ID: ENSP00000392219
MLEAHMQSYKGNDPLGEWERYIQWVEENFPENKEYLITLLEHLMKEFLDKKKYHND

SEQ ID NO: 10040 - protein, 146 aa, Homo sapiens
  Payload ID: 2011;
  Gene Symbol: BUB1;
  Gene Name: BUB1 mitotic checkpoint serine/threonine kinase;
  ENSP ID: ENSP00000402883
MLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQ

SEQ ID NO: 10041 - protein, 134 aa, Homo sapiens
  Payload ID: 2011;
  Gene Symbol: BUB1;
  Gene Name: BUB1 mitotic checkpoint serine/threonine kinase;
  ENSP ID: ENSP00000409713
MLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLF

SEQ ID NO: 10042 - protein, 1065 aa, Homo sapiens
  Payload ID: 2011;
  Gene Symbol: BUB1;
  Gene Name: BUB1 mitotic checkpoint serine/threonine kinase;
  Uniprot ID:  O43683;
  ENSP ID: ENSP00000441013
MDTPENVLQYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 10043 - protein, 1050 aa, Homo sapiens
  Payload ID: 2012;
  Gene Symbol: BUB1B;
  Gene Name: BUB1 mitotic checkpoint serine/threonine kinase B;
  Uniprot ID:  O60566;
  ENSP ID: ENSP00000287598
MAAVKKEGGALSEAMSLEGDEWELSKENVQPLRQGRIMSTLQGALAQESACNNTLQQQKRAFEYEIRFYTGNDPLDVWDRYISWTEQNYPQGGKESNMSTLLERAVEALQGEKRYYSDPRFLNLWLKLGRLCNEPLDMYSYLHNQGIGVSLAQFYISWAEEYEARENFRKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETARQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKGPSVPFSIFDEFLLSEKKNKSPPADPPRVLAQRRPLAVLKTSESITSNEDVSPDVCDEFTGIEPLSEDAIITGFRNVTICPNPEDTCDFARAARFVSTPFHEIMSLKDLPSDPERLLPEEDLDVKTSEDQQTACGTIYSQTLSIKKLSPIIEDSREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 10044 - protein, 1064 aa, Homo sapiens
  Payload ID: 2012;
  Gene Symbol: BUB1B;
  Gene Name: BUB1 mitotic checkpoint serine/threonine kinase B;
  Uniprot ID:  O60566;
  ENSP ID: ENSP00000398470
MAAVKKEGGALSEAMSLEGDEWELSKENVQPLRQGRIMSTLQGALAQESACNNTLQQQKRAFEYEIRFYTGNDPLDVWDRWVFLFHKDNRNINRYISWTEQNYPQGGKESNMSTLLERAVEALQGEKRYYSDPRFLNLWLKLGRLCNEPLDMYSYLHNQGIGVSLAQFYISWAEEYEARENFRKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETARQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKGPSVPFSIFDEFLLSEKKNKSPPADPPRVLAQRRPLAVLKTSESITSNEDVSPDVCDEFTGIEPLSEDAIITGFRNVTICPNPEDTCDFARAARFVSTPFHEIMSLKDLPSDPERLLPEEDLDVKTSEDQQTACGTIYSQTLSIKKLSPIIEDSREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 10045 - protein, 66 aa, Homo sapiens
  Payload ID: 2012;
  Gene Symbol: BUB1B;
  Gene Name: BUB1 mitotic checkpoint serine/threonine kinase B;
  ENSP ID: ENSP00000453643
  MOD_RES (1)..(1): Any amino acid
XQFQARVSRQTLLALEKEEEEEVFESSVPQRSTLAELKSKGKKTARAPIIRVGGALKGHHVKLNLV

SEQ ID NO: 10046 - protein, 96 aa, Homo sapiens
  Payload ID: 2012;
  Gene Symbol: BUB1B;
  Gene Name: BUB1 mitotic checkpoint serine/threonine kinase B;
  ENSP ID: ENSP00000453861
MAAVKKEGGALSEAMSLEGDEWELSKENVQPLRQGRIMSTLQGALAQESACNNTLQQQKRDGVSLFRPGWSAVARSWLTGSSASWVHANLLPQPPE

SEQ ID NO: 10047 - protein, 326 aa, Homo sapiens
  Payload ID: 2013;
  Gene Symbol: BUB3;
  Gene Name: BUB3 mitotic checkpoint prt;
  Uniprot ID:  O43684;
  ENSP ID: ENSP00000357851
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKST

SEQ ID NO: 10048 - protein, 145 aa, Homo sapiens
  Payload ID: 2013;
  Gene Symbol: BUB3;
  Gene Name: BUB3 mitotic checkpoint prt;
  ENSP ID: ENSP00000357852
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVHLIIL

SEQ ID NO: 10049 - protein, 328 aa, Homo sapiens
  Payload ID: 2013;
  Gene Symbol: BUB3;
  Gene Name: BUB3 mitotic checkpoint prt;
  Uniprot ID:  O43684;
  ENSP ID: ENSP00000357858
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 10050 - protein, 278 aa, Homo sapiens
  Payload ID: 2013;
  Gene Symbol: BUB3;
  Gene Name: BUB3 mitotic checkpoint prt;
  ENSP ID: ENSP00000383941
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTS

SEQ ID NO: 10051 - protein, 619 aa, Homo sapiens
  Payload ID: 2014;
  Gene Symbol: BUD13;
  Gene Name: BUD13 homolog;
  Uniprot ID:  Q9BRD0;
  ENSP ID: ENSP00000260210
MAAAPPLSKAEYLKRYLSGADAGVDRGSESGRKRRKKRPKPGGAGGKGMRIVDDDVSWTAISTTKLEKEEEEDDGDLPVVAEFVDERPEEVKQMEAFRSSAKWKLLGGHNEDLPSNRHFRHDTPDSSPRRVRHGTPDPSPRKDRHDTPDPSPRRARHDTPDPSPLRGARHDSDTSPPRRIRHDSSDTSPPRRARHDSPDPSPPRRPQHNSSGASPRRVRHDSPDPSPPRRARHGSSDISSPRRVHNNSPDTSRRTLGSSDTQQLRRARHDSPDLAPNVTYSLPRTKSGKAPERASSKTSPHWKESGASHLSFPKNSKYEYDPDISPPRKKQAKSHFGDKKQLDSKGDCQKATDSDLSSPRHKQSPGHQDSDSDLSPPRNRPRHRSSDSDLSPPRRRQRTKSSDSDLSPPRRSQPPGKKAAHMYSGAKTGLVLTDIQREQQELKEQDQETMAFEAEFQYAETVFRDKSGRKRNLKLERLEQRRKAEKDSERDELYAQWGKGLAQSRQQQQNVEDAMKEMQKPLARYIDDEDLDRMLREQEREGDPMANFIKKNKAKENKNKKVRPRYSGPAPPPNRFNIWPGYRWDGVDRSNGFEQKRFARLASKKAVEELAYKWSVEDM

SEQ ID NO: 10052 - protein, 485 aa, Homo sapiens
  Payload ID: 2014;
  Gene Symbol: BUD13;
  Gene Name: BUD13 homolog;
  Uniprot ID:  Q9BRD0;
  ENSP ID: ENSP00000364594
MAAAPPLSKAEYLKRYLSGADAGVDRGSESGRKRRKKRPKPGGAGGKGMRIVDDDVSWTAISTTKLEKEEEEDDGDLPVVAEFVDERPEEVKQMEAFRSSAKWKLLGGHNEDLPSNRHFRHDTPDSSPRRVRHGTPDPSPRKDRHDTPDPSPRRARHDTPDPSPLRGARHDSDTSPPRRIRHDSSDTSPPRRARHDSPDPSPPRRPQHNSSGDCQKATDSDLSSPRHKQSPGHQDSDSDLSPPRNRPRHRSSDSDLSPPRRRQRTKSSDSDLSPPRRSQPPGKKAAHMYSGAKTGLVLTDIQREQQELKEQDQETMAFEAEFQYAETVFRDKSGRKRNLKLERLEQRRKAEKDSERDELYAQWGKGLAQSRQQQQNVEDAMKEMQKPLARYIDDEDLDRMLREQEREGDPMANFIKKNKAKENKNKKVRPRYSGPAPPPNRFNIWPGYRWDGVDRSNGFEQKRFARLASKKAVEELAYKWSVEDM

SEQ ID NO: 10053 - protein, 118 aa, Homo sapiens
  Payload ID: 2014;
  Gene Symbol: BUD13;
  Gene Name: BUD13 homolog;
  ENSP ID: ENSP00000415748
  MOD_RES (1)..(1): Any amino acid
XSRRTLGSSDTQQLRRARHDSPDLAPNVTYSLPRTKSGKAPERASSKTSPHWKESGASHLSFPKNSKYEYDPDISPPRKKQAKSHFGDKKQLDSKEPATATKCGGCNERDAKASGPLY

SEQ ID NO: 10054 - protein, 144 aa, Homo sapiens
  Payload ID: 2015;
  Gene Symbol: BUD31;
  Gene Name: BUD31 homolog;
  Uniprot ID:  P41223;
  ENSP ID: ENSP00000222969
MPKVKRSRKAPPDGWELIEPTLDELDQKMREAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVGRIIECTHCGCRGCSG

SEQ ID NO: 10055 - protein, 144 aa, Homo sapiens; identical to SEQ ID NO: 10054
  Payload ID: 2015;
  Gene Symbol: BUD31;
  Gene Name: BUD31 homolog;
  Uniprot ID:  P41223;
  ENSP ID: ENSP00000386023

SEQ ID NO: 10056 - protein, 103 aa, Homo sapiens
  Payload ID: 2015;
  Gene Symbol: BUD31;
  Gene Name: BUD31 homolog;
  ENSP ID: ENSP00000395269
MPKVKRSRKAPPDGWELIEPTLDELDQKMREELYEYCIKEGYADKNLIAKWKKQGYENLCCLRCIQTRDTNFGTNCICRVPKSKLEVGRIIECTHCGCRGCSG

SEQ ID NO: 10057 - protein, 115 aa, Homo sapiens
  Payload ID: 2015;
  Gene Symbol: BUD31;
  Gene Name: BUD31 homolog;
  ENSP ID: ENSP00000408269
MIAETEPHEGKRKVESLWPIFRIHHQKTRYIFDLFYKRKAISRELYEYCIKEGYADKNLIAKWKKQGYENLCCLRCIQTRDTNFGTNCICRVPKSKLEVGRIIECTHCGCRGCSG

SEQ ID NO: 10058 - protein, 37 aa, Homo sapiens
  Payload ID: 2015;
  Gene Symbol: BUD31;
  Gene Name: BUD31 homolog;
  ENSP ID: ENSP00000416698
MPKVKRSRKAPPDGWELIEPTLDELDQKMREGCSAVA

SEQ ID NO: 10059 - protein, 387 aa, Homo sapiens
  Payload ID: 2016;
  Gene Symbol: BBOX1;
  Gene Name: butyrobetaine (gamma), 2-oxoglutarate dioxygenase (gamma-butyrobetaine hydroxylase) 1;
  Uniprot ID:  O75936;
  ENSP ID: ENSP00000263182
MACTIQKAEALDGAHLMQILWYDEEESLYPAVWLRDNCPCSDCYLDSAKARKLLVEALDVNIGIKGLIFDRKKVYITWPDEHYSEFQADWLKKRCFSKQARAKLQRELFFPECQYWGSELQLPTLDFEDVLRYDEHAYKWLSTLKKVGIVRLTGASDKPGEVSKLGKRMGFLYLTFYGHTWQVQDKIDANNVAYTTGKLSFHTDYPALHHPPGVQLLHCIKQTVTGGDSEIVDGFNVCQKLKKNNPQAFQILSSTFVDFTDIGVDYCDFSVQSKHKIIELDDKGQVVRINFNNATRDTIFDVPVERVQPFYAALKEFVDLMNSKESKFTFKMNPGDVITFDNWRLLHGRRSYEAGTEISRHLEGAYADWDVVMSRLRILRQRVENGN

SEQ ID NO: 10060 - protein, 387 aa, Homo sapiens; identical to SEQ ID NO: 10059
  Payload ID: 2016;
  Gene Symbol: BBOX1;
  Gene Name: butyrobetaine (gamma), 2-oxoglutarate dioxygenase (gamma-butyrobetaine hydroxylase) 1;
  Uniprot ID:  O75936;
  ENSP ID: ENSP00000433772

SEQ ID NO: 10061 - protein, 387 aa, Homo sapiens; identical to SEQ ID NO: 10059
  Payload ID: 2016;
  Gene Symbol: BBOX1;
  Gene Name: butyrobetaine (gamma), 2-oxoglutarate dioxygenase (gamma-butyrobetaine hydroxylase) 1;
  Uniprot ID:  O75936;
  ENSP ID: ENSP00000434918

SEQ ID NO: 10062 - protein, 68 aa, Homo sapiens
  Payload ID: 2016;
  Gene Symbol: BBOX1;
  Gene Name: butyrobetaine (gamma), 2-oxoglutarate dioxygenase (gamma-butyrobetaine hydroxylase) 1;
  ENSP ID: ENSP00000435369
MACTIQKAEALDGAHLMQILWYDEEESLYPAVWLRDNCPCSDCYLDSAKARKLLVEALDVNIGIKGLI

SEQ ID NO: 10063 - protein, 387 aa, Homo sapiens; identical to SEQ ID NO: 10059
  Payload ID: 2016;
  Gene Symbol: BBOX1;
  Gene Name: butyrobetaine (gamma), 2-oxoglutarate dioxygenase (gamma-butyrobetaine hydroxylase) 1;
  Uniprot ID:  O75936;
  ENSP ID: ENSP00000435781

SEQ ID NO: 10064 - protein, 526 aa, Homo sapiens
  Payload ID: 2017;
  Gene Symbol: BTN1A1;
  Gene Name: butyrophilin, subfamily 1, member A1;
  Uniprot ID:  Q13410;
  ENSP ID: ENSP00000244513
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTFSGPLRPFFCLWSSGKKPLTICPIADGPERVTVIANAQDLSKEIPLSPMGEDSAPRDADTLHSKLIPTQPSQGAP

SEQ ID NO: 10065 - protein, 494 aa, Homo sapiens
  Payload ID: 2017;
  Gene Symbol: BTN1A1;
  Gene Name: butyrophilin, subfamily 1, member A1;
  ENSP ID: ENSP00000484707
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTVIANAQDLSKEIPLSPMGEDSAPRDADTLHSKLIPTQPSQGAP

SEQ ID NO: 10066 - protein, 527 aa, Homo sapiens
  Payload ID: 2018;
  Gene Symbol: BTN2A1;
  Gene Name: butyrophilin, subfamily 2, member A1;
  Uniprot ID:  Q7KYR7;
  ENSP ID: ENSP00000312158
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 10067 - protein, 151 aa, Homo sapiens
  Payload ID: 2018;
  Gene Symbol: BTN2A1;
  Gene Name: butyrophilin, subfamily 2, member A1;
  ENSP ID: ENSP00000366825
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAELLEAEVY

SEQ ID NO: 10068 - protein, 334 aa, Homo sapiens
  Payload ID: 2018;
  Gene Symbol: BTN2A1;
  Gene Name: butyrophilin, subfamily 2, member A1;
  Uniprot ID:  Q7KYR7;
  ENSP ID: ENSP00000416945
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAELQFFSN

SEQ ID NO: 10069 - protein, 78 aa, Homo sapiens
  Payload ID: 2018;
  Gene Symbol: BTN2A1;
  Gene Name: butyrophilin, subfamily 2, member A1;
  ENSP ID: ENSP00000418936
  MOD_RES (1)..(1): Any amino acid
XIIVVILMIPIAVCIYWINKLQKEKKILSGEKEFERETREIALKELEKERVQKEEELQVKEKLQEELRWRRTFLHAGW

SEQ ID NO: 10070 - protein, 330 aa, Homo sapiens
  Payload ID: 2018;
  Gene Symbol: BTN2A1;
  Gene Name: butyrophilin, subfamily 2, member A1;
  Uniprot ID:  Q7KYR7;
  ENSP ID: ENSP00000419043
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAGPV

SEQ ID NO: 10071 - protein, 85 aa, Homo sapiens
  Payload ID: 2018;
  Gene Symbol: BTN2A1;
  Gene Name: butyrophilin, subfamily 2, member A1;
  ENSP ID: ENSP00000420447
MEVRWFRSQFSPAVFVYKGGRERTEEQMEEYRGRTTFVSKDISRGSVALVIHNITAQENGTYRCYFQEGRSYDEAILHLVVAGLG

SEQ ID NO: 10072 - protein, 466 aa, Homo sapiens
  Payload ID: 2018;
  Gene Symbol: BTN2A1;
  Gene Name: butyrophilin, subfamily 2, member A1;
  Uniprot ID:  Q7KYR7;
  ENSP ID: ENSP00000443909
MEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 10073 - protein, 407 aa, Homo sapiens
  Payload ID: 2019;
  Gene Symbol: BTN2A2;
  Gene Name: butyrophilin, subfamily 2, member A2;
  Uniprot ID:  Q8WVV5;
  ENSP ID: ENSP00000337117
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 10074 - protein, 523 aa, Homo sapiens
  Payload ID: 2019;
  Gene Symbol: BTN2A2;
  Gene Name: butyrophilin, subfamily 2, member A2;
  Uniprot ID:  Q8WVV5;
  ENSP ID: ENSP00000349143
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 10075 - protein, 256 aa, Homo sapiens
  Payload ID: 2019;
  Gene Symbol: BTN2A2;
  Gene Name: butyrophilin, subfamily 2, member A2;
  Uniprot ID:  Q8WVV5;
  ENSP ID: ENSP00000394241
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAESFMPSASPWMVALAVILTASPWMVSMTVILAVFIIFMAVSICCIKKLQREKKILSGEKKVEQEEKEIAQQLQEELRWRRTFLHAGYELPGIRGPSWKRPLHGEPPSAF

SEQ ID NO: 10076 - protein, 523 aa, Homo sapiens; identical to SEQ ID NO: 10074
  Payload ID: 2019;
  Gene Symbol: BTN2A2;
  Gene Name: butyrophilin, subfamily 2, member A2;
  Uniprot ID:  Q8WVV5;
  ENSP ID: ENSP00000399308

SEQ ID NO: 10077 - protein, 56 aa, Homo sapiens
  Payload ID: 2019;
  Gene Symbol: BTN2A2;
  Gene Name: butyrophilin, subfamily 2, member A2;
  ENSP ID: ENSP00000417129
FIIFMAVSICCIKKLQREKKILSGEKKVEQEEKEIAQQLQEELRWRRTFLHAGECL

SEQ ID NO: 10078 - protein, 336 aa, Homo sapiens
  Payload ID: 2019;
  Gene Symbol: BTN2A2;
  Gene Name: butyrophilin, subfamily 2, member A2;
  Uniprot ID:  Q8WVV5;
  ENSP ID: ENSP00000417472
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHADVNLTGLRNT

SEQ ID NO: 10079 - protein, 96 aa, Homo sapiens
  Payload ID: 2019;
  Gene Symbol: BTN2A2;
  Gene Name: butyrophilin, subfamily 2, member A2;
  ENSP ID: ENSP00000417511
MEPAAALHFSLPASLLLLLLLLLLSLCALVSAQFTVVGPANPILAMVGENTTLRCHLSPEKNAEDMEVRWFRSQFSPAVFVYKGGRERTEEQMEEY

SEQ ID NO: 10080 - protein, 80 aa, Homo sapiens
  Payload ID: 2019;
  Gene Symbol: BTN2A2;
  Gene Name: butyrophilin, subfamily 2, member A2;
  ENSP ID: ENSP00000417676
MVTTAVIIRDKYVRNVSCSVNNTLLGQEKETVIFIPESFMPSASPWMVALAVILTASPWMVSMTVILAVFIIFMAVSICC

SEQ ID NO: 10081 - protein, 184 aa, Homo sapiens
  Payload ID: 2019;
  Gene Symbol: BTN2A2;
  Gene Name: butyrophilin, subfamily 2, member A2;
  ENSP ID: ENSP00000418176
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEK

SEQ ID NO: 10082 - protein, 39 aa, Homo sapiens
  Payload ID: 2019;
  Gene Symbol: BTN2A2;
  Gene Name: butyrophilin, subfamily 2, member A2;
  ENSP ID: ENSP00000418657
MEPAAALHFSLPASLLLLLLLLLLSLCALVSVLPRSVCV

SEQ ID NO: 10083 - protein, 239 aa, Homo sapiens
  Payload ID: 2019;
  Gene Symbol: BTN2A2;
  Gene Name: butyrophilin, subfamily 2, member A2;
  ENSP ID: ENSP00000418857
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIF

SEQ ID NO: 10084 - protein, 237 aa, Homo sapiens
  Payload ID: 2019;
  Gene Symbol: BTN2A2;
  Gene Name: butyrophilin, subfamily 2, member A2;
  ENSP ID: ENSP00000418965
MVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKES

SEQ ID NO: 10085 - protein, 110 aa, Homo sapiens
  Payload ID: 2019;
  Gene Symbol: BTN2A2;
  Gene Name: butyrophilin, subfamily 2, member A2;
  ENSP ID: ENSP00000419226
MEPAAALHFSLPASLLLLLLLLLLSLCALVSGLGSKPLIEIKAQEDGSIWLECISGGWYPEPLTVWRDPYGEVVPALKEVSIADADGLFMVTTAVIIRDKYVRNVSCSVN

SEQ ID NO: 10086 - protein, 313 aa, Homo sapiens
  Payload ID: 2019;
  Gene Symbol: BTN2A2;
  Gene Name: butyrophilin, subfamily 2, member A2;
  Uniprot ID:  Q8WVV5;
  ENSP ID: ENSP00000419451
MEPAAALHFSLPASLLLLLLLLLLSLCALVSESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 10087 - protein, 513 aa, Homo sapiens
  Payload ID: 2020;
  Gene Symbol: BTN3A1;
  Gene Name: butyrophilin, subfamily 3, member A1;
  Uniprot ID:  O00481;
  ENSP ID: ENSP00000289361
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 10088 - protein, 119 aa, Homo sapiens
  Payload ID: 2020;
  Gene Symbol: BTN3A1;
  Gene Name: butyrophilin, subfamily 3, member A1;
  ENSP ID: ENSP00000394937
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTAS

SEQ ID NO: 10089 - protein, 378 aa, Homo sapiens
  Payload ID: 2020;
  Gene Symbol: BTN3A1;
  Gene Name: butyrophilin, subfamily 3, member A1;
  Uniprot ID:  O00481;
  ENSP ID: ENSP00000396684
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPGPPIGQTQQQTRGQGSPVALSQESAQRTDSWGPEEGGES

SEQ ID NO: 10090 - protein, 43 aa, Homo sapiens
  Payload ID: 2020;
  Gene Symbol: BTN3A1;
  Gene Name: butyrophilin, subfamily 3, member A1;
  ENSP ID: ENSP00000399393
MKMASFLAFLLLNFRVCLLLLQLLMPHSAQFSVLGPSGPILAM

SEQ ID NO: 10091 - protein, 461 aa, Homo sapiens
  Payload ID: 2020;
  Gene Symbol: BTN3A1;
  Gene Name: butyrophilin, subfamily 3, member A1;
  Uniprot ID:  O00481;
  ENSP ID: ENSP00000406667
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 10092 - protein, 352 aa, Homo sapiens
  Payload ID: 2020;
  Gene Symbol: BTN3A1;
  Gene Name: butyrophilin, subfamily 3, member A1;
  Uniprot ID:  O00481;
  ENSP ID: ENSP00000420010
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPGEEMLQMRLHFVK

SEQ ID NO: 10093 - protein, 91 aa, Homo sapiens
  Payload ID: 2020;
  Gene Symbol: BTN3A1;
  Gene Name: butyrophilin, subfamily 3, member A1;
  ENSP ID: ENSP00000427013
MKMASFLAFLLLNFRVCLLLLQLLMPHSAQFSVLGPSGPILAMVGEDADLPCHLFPTMSAETMELKWVSSSLRQVVNVYADGKEVEDRQSA

SEQ ID NO: 10094 - protein, 334 aa, Homo sapiens
  Payload ID: 2021;
  Gene Symbol: BTN3A2;
  Gene Name: butyrophilin, subfamily 3, member A2;
  Uniprot ID:  P78410;
  ENSP ID: ENSP00000348751
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 10095 - protein, 334 aa, Homo sapiens; identical to SEQ ID NO: 10094
  Payload ID: 2021;
  Gene Symbol: BTN3A2;
  Gene Name: butyrophilin, subfamily 3, member A2;
  Uniprot ID:  P78410;
  ENSP ID: ENSP00000366937

SEQ ID NO: 10096 - protein, 311 aa, Homo sapiens
  Payload ID: 2021;
  Gene Symbol: BTN3A2;
  Gene Name: butyrophilin, subfamily 3, member A2;
  Uniprot ID:  P78410;
  ENSP ID: ENSP00000380140
MGIPRAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 10097 - protein, 334 aa, Homo sapiens; identical to SEQ ID NO: 10094
  Payload ID: 2021;
  Gene Symbol: BTN3A2;
  Gene Name: butyrophilin, subfamily 3, member A2;
  Uniprot ID:  P78410;
  ENSP ID: ENSP00000380152

SEQ ID NO: 10098 - protein, 334 aa, Homo sapiens; identical to SEQ ID NO: 10094
  Payload ID: 2021;
  Gene Symbol: BTN3A2;
  Gene Name: butyrophilin, subfamily 3, member A2;
  Uniprot ID:  P78410;
  ENSP ID: ENSP00000432138

SEQ ID NO: 10099 - protein, 159 aa, Homo sapiens
  Payload ID: 2021;
  Gene Symbol: BTN3A2;
  Gene Name: butyrophilin, subfamily 3, member A2;
  ENSP ID: ENSP00000433749
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVADPFFRSAQPWIAALA

SEQ ID NO: 10100 - protein, 43 aa, Homo sapiens
  Payload ID: 2021;
  Gene Symbol: BTN3A2;
  Gene Name: butyrophilin, subfamily 3, member A2;
  ENSP ID: ENSP00000433880
MKMASSLAFLLLNFHVSLLLVQLLTPCSGLCSPLGSLYLAFPV

SEQ ID NO: 10101 - protein, 115 aa, Homo sapiens
  Payload ID: 2021;
  Gene Symbol: BTN3A2;
  Gene Name: butyrophilin, subfamily 3, member A2;
  ENSP ID: ENSP00000434102
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGY

SEQ ID NO: 10102 - protein, 196 aa, Homo sapiens
  Payload ID: 2021;
  Gene Symbol: BTN3A2;
  Gene Name: butyrophilin, subfamily 3, member A2;
  ENSP ID: ENSP00000435952
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIA

SEQ ID NO: 10103 - protein, 292 aa, Homo sapiens
  Payload ID: 2021;
  Gene Symbol: BTN3A2;
  Gene Name: butyrophilin, subfamily 3, member A2;
  Uniprot ID:  P78410;
  ENSP ID: ENSP00000442687
MVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 10104 - protein, 115 aa, Homo sapiens
  Payload ID: 2021;
  Gene Symbol: BTN3A2;
  Gene Name: butyrophilin, subfamily 3, member A2;
  ENSP ID: ENSP00000474533
RGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTREWL

SEQ ID NO: 10105 - protein, 584 aa, Homo sapiens
  Payload ID: 2022;
  Gene Symbol: BTN3A3;
  Gene Name: butyrophilin, subfamily 3, member A3;
  Uniprot ID:  O00478;
  ENSP ID: ENSP00000244519
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 10106 - protein, 535 aa, Homo sapiens
  Payload ID: 2022;
  Gene Symbol: BTN3A3;
  Gene Name: butyrophilin, subfamily 3, member A3;
  Uniprot ID:  O00478;
  ENSP ID: ENSP00000355238
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 10107 - protein, 137 aa, Homo sapiens
  Payload ID: 2022;
  Gene Symbol: BTN3A3;
  Gene Name: butyrophilin, subfamily 3, member A3;
  ENSP ID: ENSP00000417234
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKA

SEQ ID NO: 10108 - protein, 140 aa, Homo sapiens
  Payload ID: 2022;
  Gene Symbol: BTN3A3;
  Gene Name: butyrophilin, subfamily 3, member A3;
  ENSP ID: ENSP00000417717
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDT

SEQ ID NO: 10109 - protein, 127 aa, Homo sapiens
  Payload ID: 2022;
  Gene Symbol: BTN3A3;
  Gene Name: butyrophilin, subfamily 3, member A3;
  ENSP ID: ENSP00000419312
MKMASSLAFLLLNFHVSLFLVQLLTPCSDADLPCHLFPTMSAETMELRWVSSSLRQVVNVYADGKEVEDRQSAPYRGRTSILRDGITAGKAALRIHNVTASDSGKYLCYFQDGDFYEKALVELKVAA

SEQ ID NO: 10110 - protein, 250 aa, Homo sapiens
  Payload ID: 2022;
  Gene Symbol: BTN3A3;
  Gene Name: butyrophilin, subfamily 3, member A3;
  ENSP ID: ENSP00000419445
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKE

SEQ ID NO: 10111 - protein, 210 aa, Homo sapiens
  Payload ID: 2022;
  Gene Symbol: BTN3A3;
  Gene Name: butyrophilin, subfamily 3, member A3;
  ENSP ID: ENSP00000419736
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAEWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKK

SEQ ID NO: 10112 - protein, 237 aa, Homo sapiens
  Payload ID: 2022;
  Gene Symbol: BTN3A3;
  Gene Name: butyrophilin, subfamily 3, member A3;
  ENSP ID: ENSP00000420147
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISI

SEQ ID NO: 10113 - protein, 100 aa, Homo sapiens
  Payload ID: 2022;
  Gene Symbol: BTN3A3;
  Gene Name: butyrophilin, subfamily 3, member A3;
  ENSP ID: ENSP00000420339
MVGEDADLPCHLFPTMSAETMELRWVSSSLRQVVNVYADGKEVEDRQSAPYRGRTSILRDGITAGKAALRIHNVTASDSGKYLCYFQDGDFYEKALVELK

SEQ ID NO: 10114 - protein, 455 aa, Homo sapiens
  Payload ID: 2023;
  Gene Symbol: BTNL2;
  Gene Name: butyrophilin-like 2;
  Uniprot ID:  Q9UIR0;
  ENSP ID: ENSP00000364132
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 10115 - protein, 108 aa, Homo sapiens
  Payload ID: 2023;
  Gene Symbol: BTNL2;
  Gene Name: butyrophilin-like 2;
  ENSP ID: ENSP00000387852
MVDFPGYNLSGAVASFLFILLTMKQSDFRVIGPAHPILAGVGEDALLTCQLLPKRTTMHVEVRWYRSEPSTPVFVHRDGVEVTEMQMEEYRGWVEWIENGIAKGNVAL

SEQ ID NO: 10116 - protein, 108 aa, Homo sapiens; identical to SEQ ID NO: 10115
  Payload ID: 2023;
  Gene Symbol: BTNL2;
  Gene Name: butyrophilin-like 2;
  ENSP ID: ENSP00000388434

SEQ ID NO: 10117 - protein, 482 aa, Homo sapiens
  Payload ID: 2023;
  Gene Symbol: BTNL2;
  Gene Name: butyrophilin-like 2;
  ENSP ID: ENSP00000390613
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSESRMTFLWKTLLVWGLLLAVAVGLPRKRS

SEQ ID NO: 10118 - protein, 68 aa, Homo sapiens
  Payload ID: 2023;
  Gene Symbol: BTNL2;
  Gene Name: butyrophilin-like 2;
  ENSP ID: ENSP00000394258
MVDFPGYNLSGAVASFLFILLTMKQSEDFRVIGPAHPILAGVGEDALLTCQLLPKRTTMHVEVRETPD

SEQ ID NO: 10119 - protein, 68 aa, Homo sapiens; identical to SEQ ID NO: 10118
  Payload ID: 2023;
  Gene Symbol: BTNL2;
  Gene Name: butyrophilin-like 2;
  ENSP ID: ENSP00000394365

SEQ ID NO: 10120 - protein, 108 aa, Homo sapiens; identical to SEQ ID NO: 10115
  Payload ID: 2023;
  Gene Symbol: BTNL2;
  Gene Name: butyrophilin-like 2;
  ENSP ID: ENSP00000394378

SEQ ID NO: 10121 - protein, 68 aa, Homo sapiens; identical to SEQ ID NO: 10118
  Payload ID: 2023;
  Gene Symbol: BTNL2;
  Gene Name: butyrophilin-like 2;
  ENSP ID: ENSP00000394970

SEQ ID NO: 10122 - protein, 68 aa, Homo sapiens; identical to SEQ ID NO: 10118
  Payload ID: 2023;
  Gene Symbol: BTNL2;
  Gene Name: butyrophilin-like 2;
  ENSP ID: ENSP00000396343

SEQ ID NO: 10123 - protein, 482 aa, Homo sapiens; identical to SEQ ID NO: 10117
  Payload ID: 2023;
  Gene Symbol: BTNL2;
  Gene Name: butyrophilin-like 2;
  ENSP ID: ENSP00000399884

SEQ ID NO: 10124 - protein, 482 aa, Homo sapiens
  Payload ID: 2023;
  Gene Symbol: BTNL2;
  Gene Name: butyrophilin-like 2;
  ENSP ID: ENSP00000402639
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDEDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSESRMTFLWKTLLVWGLLLAVAVGLPRKRS

SEQ ID NO: 10125 - protein, 482 aa, Homo sapiens; identical to SEQ ID NO: 10124
  Payload ID: 2023;
  Gene Symbol: BTNL2;
  Gene Name: butyrophilin-like 2;
  ENSP ID: ENSP00000405794

SEQ ID NO: 10126 - protein, 68 aa, Homo sapiens; identical to SEQ ID NO: 10118
  Payload ID: 2023;
  Gene Symbol: BTNL2;
  Gene Name: butyrophilin-like 2;
  ENSP ID: ENSP00000409507

SEQ ID NO: 10127 - protein, 108 aa, Homo sapiens; identical to SEQ ID NO: 10115
  Payload ID: 2023;
  Gene Symbol: BTNL2;
  Gene Name: butyrophilin-like 2;
  ENSP ID: ENSP00000411385

SEQ ID NO: 10128 - protein, 108 aa, Homo sapiens; identical to SEQ ID NO: 10115
  Payload ID: 2023;
  Gene Symbol: BTNL2;
  Gene Name: butyrophilin-like 2;
  ENSP ID: ENSP00000411676

SEQ ID NO: 10129 - protein, 108 aa, Homo sapiens; identical to SEQ ID NO: 10115
  Payload ID: 2023;
  Gene Symbol: BTNL2;
  Gene Name: butyrophilin-like 2;
  ENSP ID: ENSP00000411765

SEQ ID NO: 10130 - protein, 108 aa, Homo sapiens; identical to SEQ ID NO: 10115
  Payload ID: 2023;
  Gene Symbol: BTNL2;
  Gene Name: butyrophilin-like 2;
  ENSP ID: ENSP00000411884

SEQ ID NO: 10131 - protein, 68 aa, Homo sapiens; identical to SEQ ID NO: 10118
  Payload ID: 2023;
  Gene Symbol: BTNL2;
  Gene Name: butyrophilin-like 2;
  ENSP ID: ENSP00000413300

SEQ ID NO: 10132 - protein, 482 aa, Homo sapiens; identical to SEQ ID NO: 10124
  Payload ID: 2023;
  Gene Symbol: BTNL2;
  Gene Name: butyrophilin-like 2;
  ENSP ID: ENSP00000414407

SEQ ID NO: 10133 - protein, 482 aa, Homo sapiens; identical to SEQ ID NO: 10117
  Payload ID: 2023;
  Gene Symbol: BTNL2;
  Gene Name: butyrophilin-like 2;
  ENSP ID: ENSP00000414811

SEQ ID NO: 10134 - protein, 482 aa, Homo sapiens; identical to SEQ ID NO: 10117
  Payload ID: 2023;
  Gene Symbol: BTNL2;
  Gene Name: butyrophilin-like 2;
  ENSP ID: ENSP00000415396

SEQ ID NO: 10135 - protein, 482 aa, Homo sapiens; identical to SEQ ID NO: 10117
  Payload ID: 2023;
  Gene Symbol: BTNL2;
  Gene Name: butyrophilin-like 2;
  ENSP ID: ENSP00000416544

SEQ ID NO: 10136 - protein, 108 aa, Homo sapiens; identical to SEQ ID NO: 10115
  Payload ID: 2023;
  Gene Symbol: BTNL2;
  Gene Name: butyrophilin-like 2;
  ENSP ID: ENSP00000416987

SEQ ID NO: 10137 - protein, 68 aa, Homo sapiens; identical to SEQ ID NO: 10118
  Payload ID: 2023;
  Gene Symbol: BTNL2;
  Gene Name: butyrophilin-like 2;
  ENSP ID: ENSP00000420063

SEQ ID NO: 10138 - protein, 178 aa, Homo sapiens
  Payload ID: 2023;
  Gene Symbol: BTNL2;
  Gene Name: butyrophilin-like 2;
  Uniprot ID:  Q9UIR0;
  ENSP ID: ENSP00000443364
MEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 10139 - protein, 178 aa, Homo sapiens
  Payload ID: 2023;
  Gene Symbol: BTNL2;
  Gene Name: butyrophilin-like 2;
  Uniprot ID:  Q9UIR0;
  ENSP ID: ENSP00000446794
MEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 10140 - protein, 178 aa, Homo sapiens; identical to SEQ ID NO: 10139
  Payload ID: 2023;
  Gene Symbol: BTNL2;
  Gene Name: butyrophilin-like 2;
  Uniprot ID:  Q9UIR0;
  ENSP ID: ENSP00000446915

SEQ ID NO: 10141 - protein, 178 aa, Homo sapiens; identical to SEQ ID NO: 10138
  Payload ID: 2023;
  Gene Symbol: BTNL2;
  Gene Name: butyrophilin-like 2;
  Uniprot ID:  Q9UIR0;
  ENSP ID: ENSP00000447291

SEQ ID NO: 10142 - protein, 178 aa, Homo sapiens; identical to SEQ ID NO: 10138
  Payload ID: 2023;
  Gene Symbol: BTNL2;
  Gene Name: butyrophilin-like 2;
  Uniprot ID:  Q9UIR0;
  ENSP ID: ENSP00000447616

SEQ ID NO: 10143 - protein, 245 aa, Homo sapiens
  Payload ID: 2023;
  Gene Symbol: BTNL2;
  Gene Name: butyrophilin-like 2;
  Uniprot ID:  Q9UIR0;
  ENSP ID: ENSP00000447733
MVDFPGYNLSGAVASFLFILLTMKQSEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 10144 - protein, 455 aa, Homo sapiens; identical to SEQ ID NO: 10114
  Payload ID: 2023;
  Gene Symbol: BTNL2;
  Gene Name: butyrophilin-like 2;
  Uniprot ID:  Q9UIR0;
  ENSP ID: ENSP00000447985

SEQ ID NO: 10145 - protein, 455 aa, Homo sapiens; identical to SEQ ID NO: 10114
  Payload ID: 2023;
  Gene Symbol: BTNL2;
  Gene Name: butyrophilin-like 2;
  Uniprot ID:  Q9UIR0;
  ENSP ID: ENSP00000448023

SEQ ID NO: 10146 - protein, 455 aa, Homo sapiens
  Payload ID: 2023;
  Gene Symbol: BTNL2;
  Gene Name: butyrophilin-like 2;
  ENSP ID: ENSP00000448277
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDEDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 10147 - protein, 178 aa, Homo sapiens; identical to SEQ ID NO: 10138
  Payload ID: 2023;
  Gene Symbol: BTNL2;
  Gene Name: butyrophilin-like 2;
  Uniprot ID:  Q9UIR0;
  ENSP ID: ENSP00000448550

SEQ ID NO: 10148 - protein, 245 aa, Homo sapiens
  Payload ID: 2023;
  Gene Symbol: BTNL2;
  Gene Name: butyrophilin-like 2;
  Uniprot ID:  Q9UIR0;
  ENSP ID: ENSP00000448852
MVDFPGYNLSGAVASFLFILLTMKQSEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 10149 - protein, 455 aa, Homo sapiens; identical to SEQ ID NO: 10146
  Payload ID: 2023;
  Gene Symbol: BTNL2;
  Gene Name: butyrophilin-like 2;
  ENSP ID: ENSP00000448929

SEQ ID NO: 10150 - protein, 455 aa, Homo sapiens; identical to SEQ ID NO: 10146
  Payload ID: 2023;
  Gene Symbol: BTNL2;
  Gene Name: butyrophilin-like 2;
  ENSP ID: ENSP00000449292

SEQ ID NO: 10151 - protein, 178 aa, Homo sapiens; identical to SEQ ID NO: 10139
  Payload ID: 2023;
  Gene Symbol: BTNL2;
  Gene Name: butyrophilin-like 2;
  Uniprot ID:  Q9UIR0;
  ENSP ID: ENSP00000449356

SEQ ID NO: 10152 - protein, 455 aa, Homo sapiens; identical to SEQ ID NO: 10114
  Payload ID: 2023;
  Gene Symbol: BTNL2;
  Gene Name: butyrophilin-like 2;
  Uniprot ID:  Q9UIR0;
  ENSP ID: ENSP00000449365

SEQ ID NO: 10153 - protein, 455 aa, Homo sapiens; identical to SEQ ID NO: 10114
  Payload ID: 2023;
  Gene Symbol: BTNL2;
  Gene Name: butyrophilin-like 2;
  Uniprot ID:  Q9UIR0;
  ENSP ID: ENSP00000449546

SEQ ID NO: 10154 - protein, 178 aa, Homo sapiens; identical to SEQ ID NO: 10138
  Payload ID: 2023;
  Gene Symbol: BTNL2;
  Gene Name: butyrophilin-like 2;
  Uniprot ID:  Q9UIR0;
  ENSP ID: ENSP00000449578

SEQ ID NO: 10155 - protein, 245 aa, Homo sapiens; identical to SEQ ID NO: 10143
  Payload ID: 2023;
  Gene Symbol: BTNL2;
  Gene Name: butyrophilin-like 2;
  Uniprot ID:  Q9UIR0;
  ENSP ID: ENSP00000450139

SEQ ID NO: 10156 - protein, 178 aa, Homo sapiens
  Payload ID: 2023;
  Gene Symbol: BTNL2;
  Gene Name: butyrophilin-like 2;
  ENSP ID: ENSP00000479046
MEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQLICSSDGWFPQPHVQWRDMEGKTIPSSSQALTQGSHGLFHVQTLLRVTNISAVDVTCSISIPFLGEEKIATFSLSGW

SEQ ID NO: 10157 - protein, 455 aa, Homo sapiens
  Payload ID: 2023;
  Gene Symbol: BTNL2;
  Gene Name: butyrophilin-like 2;
  ENSP ID: ENSP00000483322
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVGLGSSPLITVEGQEDGEMQLICSSDGWFPQPHVQWRDMEGKTIPSSSQALTQGSHGLFHVQTLLRVTNISAVDVTCSISIPFLGEEKIATFSLSGW

SEQ ID NO: 10158 - protein, 466 aa, Homo sapiens
  Payload ID: 2024;
  Gene Symbol: BTNL3;
  Gene Name: butyrophilin-like 3;
  Uniprot ID:  Q6UXE8;
  ENSP ID: ENSP00000341787
MAFVLILVLSFYELVSGQWQVTGPGKFVQALVGEDAVFSCSLFPETSAEAMEVRFFRNQFHAVVHLYRDGEDWESKQMPQYRGRTEFVKDSIAGGRVSLRLKNITPSDIGLYGCWFSSQIYDEEATWELRVAALGSLPLISIVGYVDGGIQLLCLSSGWFPQPTAKWKGPQGQDLSSDSRANADGYSLYDVEISIIVQENAGSILCSIHLAEQSHEVESKVLIGETFFQPSPWRLASILLGLLCGALCGVVMGMIIVFFKSKGKIQAELDWRRKHGQAELRDARKHAVEVTLDPETAHPKLCVSDLKTVTHRKAPQEVPHSEKRFTRKSVVASQGFQAGKHYWEVDVGQNVGWYVGVCRDDVDRGKNNVTLSPNNGYWVLRLTTEHLYFTFNPHFISLPPSTPPTRVGVFLDYEGGTISFFNTNDQSLIYTLLTCQFEGLLRPYIQHAMYDEEKGTPIFICPVSWG

SEQ ID NO: 10159 - protein, 347 aa, Homo sapiens
  Payload ID: 2025;
  Gene Symbol: BTNL8;
  Gene Name: butyrophilin-like 8;
  Uniprot ID:  Q6UX41;
  ENSP ID: ENSP00000231229
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQCKREREAWAGALFMVPAGTGSEMLPHPAASLLLVLASRGPGPKKENPGGTGLEKKARTGRIERRPETRSGGDSGSRDGSPEALRF

SEQ ID NO: 10160 - protein, 500 aa, Homo sapiens
  Payload ID: 2025;
  Gene Symbol: BTNL8;
  Gene Name: butyrophilin-like 8;
  Uniprot ID:  Q6UX41;
  ENSP ID: ENSP00000342197
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 10161 - protein, 375 aa, Homo sapiens
  Payload ID: 2025;
  Gene Symbol: BTNL8;
  Gene Name: butyrophilin-like 8;
  Uniprot ID:  Q6UX41;
  ENSP ID: ENSP00000383543
MWTWFVKSLGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 10162 - protein, 41 aa, Homo sapiens
  Payload ID: 2025;
  Gene Symbol: BTNL8;
  Gene Name: butyrophilin-like 8;
  ENSP ID: ENSP00000422069
MHGLFDVEISLTVQENAGSISCSMRHAHLSREVESRVQIGV

SEQ ID NO: 10163 - protein, 340 aa, Homo sapiens
  Payload ID: 2025;
  Gene Symbol: BTNL8;
  Gene Name: butyrophilin-like 8;
  Uniprot ID:  Q6UX41;
  ENSP ID: ENSP00000424585
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQCKREREAWAGALFMVPAGTGSEMLPHPAASLLLVLASRGPGPKKLEKKARTGRIERRPETRSGGDSGSRDGSPEALRF

SEQ ID NO: 10164 - protein, 384 aa, Homo sapiens
  Payload ID: 2025;
  Gene Symbol: BTNL8;
  Gene Name: butyrophilin-like 8;
  Uniprot ID:  Q6UX41;
  ENSP ID: ENSP00000425207
MALMLSLVLSLLKLGSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 10165 - protein, 293 aa, Homo sapiens
  Payload ID: 2025;
  Gene Symbol: BTNL8;
  Gene Name: butyrophilin-like 8;
  ENSP ID: ENSP00000427441
MRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 10166 - protein, 316 aa, Homo sapiens
  Payload ID: 2025;
  Gene Symbol: BTNL8;
  Gene Name: butyrophilin-like 8;
  Uniprot ID:  Q6UX41;
  ENSP ID: ENSP00000435098
MHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 10167 - protein, 375 aa, Homo sapiens; identical to SEQ ID NO: 10161
  Payload ID: 2025;
  Gene Symbol: BTNL8;
  Gene Name: butyrophilin-like 8;
  Uniprot ID:  Q6UX41;
  ENSP ID: ENSP00000483717

SEQ ID NO: 10168 - protein, 535 aa, Homo sapiens
  Payload ID: 2026;
  Gene Symbol: BTNL9;
  Gene Name: butyrophilin-like 9;
  Uniprot ID:  Q6UXG8;
  ENSP ID: ENSP00000330200
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQEKLTAELEKLQTELDWRRAEGQAEWRAAQKYAVDVTLDPASAHPSLEVSEDGKSVSSRGAPPGPAPGHPQRFSEQTCALSLERFSAGRHYWEVHVGRRSRWFLGACLAAVPRAGPARLSPAAGYWVLGLWNGCEYFVLAPHRVALTLRVPPRRLGVFLDYEAGELSFFNVSDGSHIFTFHDTFSGALCAYFRPRAHDGGEHPDPLTICPLPVRGTGVPEENDSDTWLQPYEPADPALDWW

SEQ ID NO: 10169 - protein, 344 aa, Homo sapiens
  Payload ID: 2026;
  Gene Symbol: BTNL9;
  Gene Name: butyrophilin-like 9;
  Uniprot ID:  Q6UXG8;
  ENSP ID: ENSP00000366037
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQEKLTAELEKLQTELDWRRAEGQAECFVLASHPPGEGIQAASNSTTTLNA

SEQ ID NO: 10170 - protein, 315 aa, Homo sapiens
  Payload ID: 2026;
  Gene Symbol: BTNL9;
  Gene Name: butyrophilin-like 9;
  Uniprot ID:  Q6UXG8;
  ENSP ID: ENSP00000425424
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQGERGQGVLHAPAQVPKPAVI

SEQ ID NO: 10171 - protein, 246 aa, Homo sapiens
  Payload ID: 2026;
  Gene Symbol: BTNL9;
  Gene Name: butyrophilin-like 9;
  ENSP ID: ENSP00000427345
MEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQGERGQGVLHAPAQVPKPAVI

SEQ ID NO: 10172 - protein, 602 aa, Homo sapiens
  Payload ID: 2027;
  Gene Symbol: BCHE;
  Gene Name: butyrylcholinesterase;
  Uniprot ID:  P06276;
  ENSP ID: ENSP00000264381
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 10173 - protein, 132 aa, Homo sapiens
  Payload ID: 2027;
  Gene Symbol: BCHE;
  Gene Name: butyrylcholinesterase;
  ENSP ID: ENSP00000418325
AVQFTGWSSSCILHFPEVLHDFHSLQTLPSLLQRIGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 10174 - protein, 120 aa, Homo sapiens
  Payload ID: 2027;
  Gene Symbol: BCHE;
  Gene Name: butyrylcholinesterase;
  ENSP ID: ENSP00000418504
AVQFTGWSSSCILHFPEVLHDFHSLQTLPSLLQRIGNPNETQNNSTSWPVFKSTEQKYLTLNTESTRIMTKLRAQQCRFWTSFFPKVLEMTEPICCYCEPGTALAARAAQMKMTGSAYSQ

SEQ ID NO: 10175 - protein, 562 aa, Homo sapiens
  Payload ID: 2027;
  Gene Symbol: BCHE;
  Gene Name: butyrylcholinesterase;
  ENSP ID: ENSP00000419505
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTG

SEQ ID NO: 10176 - protein, 525 aa, Homo sapiens
  Payload ID: 2027;
  Gene Symbol: BCHE;
  Gene Name: butyrylcholinesterase;
  ENSP ID: ENSP00000419804
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGCSSSTILNYVLETEPVVLI

SEQ ID NO: 10177 - protein, 75 aa, Homo sapiens
  Payload ID: 2028;
  Gene Symbol:;
  Gene Name: BX004987.4;
  ENSP ID: ENSP00000484918
MVVLGMQTEEGHCIMLRGLAHSLGGTQVICKVVGLPSSIGFNTSSHLLFPATLQGAPTHFPCRWRQGGSTDNLPA

SEQ ID NO: 10178 - protein, 137 aa, Homo sapiens; identical to SEQ ID NO: 3750
  Payload ID: 2029;
  Gene Symbol:;
  Gene Name: BX248413.1;
  ENSP ID: ENSP00000484425

SEQ ID NO: 10179 - protein, 437 aa, Homo sapiens
  Payload ID: 2030;
  Gene Symbol: BYSL;
  Gene Name: bystin-like;
  Uniprot ID:  Q13895;
  ENSP ID: ENSP00000230340
MPKFKAARGVGGQEKHAPLADQILAGNAVRAGVREKRRGRGTGEAEEEYVGPRLSRRILQQARQQQEELEAEHGTGDKPAAPRERTTRLGPRMPQDGSDDEDEEWPTLEKAATMTAAGHHAEVVVDPEDERAIEMFMNKNPPARRTLADIIMEKLTEKQTEVETVMSEVSGFPMPQLDPRVLEVYRGVREVLSKYRSGKLPKAFKIIPALSNWEQILYVTEPEAWTAAAMYQATRIFASNLKERMAQRFYNLVLLPRVRDDVAEYKRLNFHLYMALKKALFKPGAWFKGILIPLCESGTCTLREAIIVGSIITKCSIPVLHSSAAMLKIAEMEYSGANSIFLRLLLDKKYALPYRVLDALVFHFLGFRTEKRELPVLWHQCLLTLVQRYKADLATDQKEALLELLRLQPHPQLSPEIRRELQSAVPRDVEDVPITVE

SEQ ID NO: 10180 - protein, 183 aa, Homo sapiens
  Payload ID: 2030;
  Gene Symbol: BYSL;
  Gene Name: bystin-like;
  ENSP ID: ENSP00000362087
  MOD_RES (1)..(1): Any amino acid
XAATMTAAGHHAEVVVDPEDERAIEMFMNKNPPARRTLADIIMEKLTEKQTEVETVMSEVSGFPMPQLDPRVLEVYRGVREVLSKYRSGKLPKAFKIIPALSNWEQILYVTEPEAWTAAAMYQATRIFASNLKERMAQRFYNLVLLPRVRDDVAEYKRLNFHLYMALKKALFKPGAWFKVAAL

SEQ ID NO: 10181 - protein, 194 aa, Homo sapiens
  Payload ID: 2030;
  Gene Symbol: BYSL;
  Gene Name: bystin-like;
  ENSP ID: ENSP00000417813
MPKFKAARGVGGQEKHAPLADQILAGNAVRAGVREKRRGRGTGEAEEEYVGPRLSRRILQQARQQQEELEAEHGTGDKPAAPRERTTRLGPRMPQDGSDDEDEEWPTLEKAATMTAAGHHAEVVVDPEDERAIEMFMNKNPPARYYLSTAVENCPRHLRSSLHSPTGSKSSTSQSRRPGLQLPCTRPPGFLPLT

SEQ ID NO: 10182 - protein, 394 aa, Homo sapiens
  Payload ID: 2031;
  Gene Symbol: C15orf38-AP3S2;
  Gene Name: C15orf38-AP3S2 readthrough;
  ENSP ID: ENSP00000381377
MSRIYHDGALRNKAVQSVRLPGAWDPAAHQGGNGVLLEGELIDVSRHSILDTHGRKERYYVLYIRPSHIHRRKFDAKGNEIEPNFSATRKVNTGFLMSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLEKSEGGLSAAPARAVSAVKNINLPEIPRNINIGDLNIKVPNLSQFV

SEQ ID NO: 10183 - protein, 185 aa, Homo sapiens
  Payload ID: 2031;
  Gene Symbol: C15orf38-AP3S2;
  Gene Name: C15orf38-AP3S2 readthrough;
  ENSP ID: ENSP00000453100
MSSYKVEAKGDTDRLTPEALKGLVNKPELLALTESLTPDHTVAFWMPESEMEVMELELGAGVRLKTRGDGPFLDSLAKLEAGTVTKCNFTGDGKTGASWTDNIMAQKCSKGAAAEIREQGDGAEDEEWVFVETLDKCFENVCELDLIFHMDKVHYILQEVVMGGMVLETNMNEIVAQIEAQNRLE

SEQ ID NO: 10184 - protein, 184 aa, Homo sapiens
  Payload ID: 2031;
  Gene Symbol: C15orf38-AP3S2;
  Gene Name: C15orf38-AP3S2 readthrough;
  ENSP ID: ENSP00000453637
MSSYNSLAKLEAGTVTKCNFTGDGKTGASWTDNIMAQKCSKGAAAEIREQGDGAEDEEWPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLE

SEQ ID NO: 10185 - protein, 141 aa, Homo sapiens
  Payload ID: 2032;
  Gene Symbol: C1D;
  Gene Name: C1D nuclear receptor corepressor;
  Uniprot ID:  Q13901;
  ENSP ID: ENSP00000348107
MAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANKGKSKS

SEQ ID NO: 10186 - protein, 180 aa, Homo sapiens
  Payload ID: 2032;
  Gene Symbol: C1D;
  Gene Name: C1D nuclear receptor corepressor;
  ENSP ID: ENSP00000384304
MPSPSVSTSAASVLEGVCGRARSTYRTPEEGEEQSWSAIMAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITDKKKAGKLDRGAASRFVKNALWEPKSKNASKVANKGKSKS

SEQ ID NO: 10187 - protein, 141 aa, Homo sapiens; identical to SEQ ID NO: 10185
  Payload ID: 2032;
  Gene Symbol: C1D;
  Gene Name: C1D nuclear receptor corepressor;
  Uniprot ID:  Q13901;
  ENSP ID: ENSP00000386468

SEQ ID NO: 10188 - protein, 141 aa, Homo sapiens; identical to SEQ ID NO: 10185
  Payload ID: 2032;
  Gene Symbol: C1D;
  Gene Name: C1D nuclear receptor corepressor;
  Uniprot ID:  Q13901;
  ENSP ID: ENSP00000386779

SEQ ID NO: 10189 - protein, 318 aa, Homo sapiens
  Payload ID: 2033;
  Gene Symbol: C1GALT1C1;
  Gene Name: C1GALT1-specific chaperone 1;
  Uniprot ID:  Q96EU7;
  ENSP ID: ENSP00000304364
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 10190 - protein, 318 aa, Homo sapiens; identical to SEQ ID NO: 10189
  Payload ID: 2033;
  Gene Symbol: C1GALT1C1;
  Gene Name: C1GALT1-specific chaperone 1;
  Uniprot ID:  Q96EU7;
  ENSP ID: ENSP00000360363

SEQ ID NO: 10191 - protein, 315 aa, Homo sapiens
  Payload ID: 2034;
  Gene Symbol: C1GALT1C1L;
  Gene Name: C1GALT1-specific chaperone 1 like;
  Uniprot ID:  P0DN25;
  ENSP ID: ENSP00000489061
MVSASGTSFFKGMLLGSISWVLITMFGQIHIRHRGQTQDHEHHHLRPPNRNDFLNTSKVILLELSKSIRVFCIIFGESEDESYWAVLKETWTKHCDKAELYDTKNDNLFNIESNDRWVQMRTAYKYVFEKYGDNYNWFFLALPTTFAVIENLKYLLFTRDASQPFYLGHTVIFGDLEYVTVEGGIVLSRELMKRLNRLLDNSETCADQSVIWKLSEDKQLAICLKYAGVHAENAEDYEGRDVFNTKPIAQLIEEALSNNPQQVVEGCCSDMAITFNGLTPQKMEVMMYGLYRLRAFGHYFNDTLVFLPPVGSEND

SEQ ID NO: 10192 - protein, 199 aa, Homo sapiens
  Payload ID: 2035;
  Gene Symbol: C1QTNF1;
  Gene Name: C1q and tumor necrosis  factor related prt 1;
  ENSP ID: ENSP00000311265
MYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 10193 - protein, 281 aa, Homo sapiens
  Payload ID: 2035;
  Gene Symbol: C1QTNF1;
  Gene Name: C1q and tumor necrosis  factor related prt 1;
  Uniprot ID:  Q9BXJ1;
  ENSP ID: ENSP00000340864
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 10194 - protein, 281 aa, Homo sapiens; identical to SEQ ID NO: 10193
  Payload ID: 2035;
  Gene Symbol: C1QTNF1;
  Gene Name: C1q and tumor necrosis  factor related prt 1;
  Uniprot ID:  Q9BXJ1;
  ENSP ID: ENSP00000343230

SEQ ID NO: 10195 - protein, 281 aa, Homo sapiens; identical to SEQ ID NO: 10193
  Payload ID: 2035;
  Gene Symbol: C1QTNF1;
  Gene Name: C1q and tumor necrosis  factor related prt 1;
  Uniprot ID:  Q9BXJ1;
  ENSP ID: ENSP00000376240

SEQ ID NO: 10196 - protein, 281 aa, Homo sapiens; identical to SEQ ID NO: 10193
  Payload ID: 2035;
  Gene Symbol: C1QTNF1;
  Gene Name: C1q and tumor necrosis  factor related prt 1;
  Uniprot ID:  Q9BXJ1;
  ENSP ID: ENSP00000462481

SEQ ID NO: 10197 - protein, 281 aa, Homo sapiens; identical to SEQ ID NO: 10193
  Payload ID: 2035;
  Gene Symbol: C1QTNF1;
  Gene Name: C1q and tumor necrosis  factor related prt 1;
  Uniprot ID:  Q9BXJ1;
  ENSP ID: ENSP00000462990

SEQ ID NO: 10198 - protein, 281 aa, Homo sapiens; identical to SEQ ID NO: 10193
  Payload ID: 2035;
  Gene Symbol: C1QTNF1;
  Gene Name: C1q and tumor necrosis  factor related prt 1;
  Uniprot ID:  Q9BXJ1;
  ENSP ID: ENSP00000463008

SEQ ID NO: 10199 - protein, 281 aa, Homo sapiens; identical to SEQ ID NO: 10193
  Payload ID: 2035;
  Gene Symbol: C1QTNF1;
  Gene Name: C1q and tumor necrosis  factor related prt 1;
  Uniprot ID:  Q9BXJ1;
  ENSP ID: ENSP00000463108

SEQ ID NO: 10200 - protein, 199 aa, Homo sapiens; identical to SEQ ID NO: 10192
  Payload ID: 2035;
  Gene Symbol: C1QTNF1;
  Gene Name: C1q and tumor necrosis  factor related prt 1;
  ENSP ID: ENSP00000463337

SEQ ID NO: 10201 - protein, 281 aa, Homo sapiens; identical to SEQ ID NO: 10193
  Payload ID: 2035;
  Gene Symbol: C1QTNF1;
  Gene Name: C1q and tumor necrosis  factor related prt 1;
  Uniprot ID:  Q9BXJ1;
  ENSP ID: ENSP00000463922

SEQ ID NO: 10202 - protein, 330 aa, Homo sapiens
  Payload ID: 2036;
  Gene Symbol: C1QTNF2;
  Gene Name: C1q and tumor necrosis  factor related prt 2;
  Uniprot ID:  Q9BXJ5;
  ENSP ID: ENSP00000377545
MGKLCLGPTLCPAAAAEESRDAEPRRELLCSGRPWTWRAAARVTTMIPWVLLACALPCAADPLLGAFARRDFRKGSPQLVCSLPGPQGPPGPPGAPGPSGMMGRMGFPGKDGQDGHDGDRGDSGEEGPPGRTGNRGKPGPKGKAGAIGRAGPRGPKGVNGTPGKHGTPGKKGPKGKKGEPGLPGPCSCGSGHTKSAFSVAVTKSYPRERLPIKFDKILMNEGGHYNASSGKFVCGVPGIYYFTYDITLANKHLAIGLVHNGQYRIRTFDANTGNHDVASGSTILALKQGDEVWLQIFYSEQNGLFYDPYWTDSLFTGFLIYADQDDPNEV

SEQ ID NO: 10203 - protein, 246 aa, Homo sapiens
  Payload ID: 2037;
  Gene Symbol: C1QTNF3;
  Gene Name: C1q and tumor necrosis  factor related prt 3;
  Uniprot ID:  Q9BXJ4;
  ENSP ID: ENSP00000231338
MLWRQLIYWQLLALFFLPFCLCQDEYMESPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 10204 - protein, 319 aa, Homo sapiens
  Payload ID: 2037;
  Gene Symbol: C1QTNF3;
  Gene Name: C1q and tumor necrosis  factor related prt 3;
  Uniprot ID:  Q9BXJ4;
  ENSP ID: ENSP00000371497
MLWRQLIYWQLLALFFLPFCLCQDEYMEVSGRTNKVVARIVQSHQQTGRSGSRREKVRERSHPKTGTVDNNTSTDLKSLRPDELPHPEVDDLAQITTFWGQSPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 10205 - protein, 329 aa, Homo sapiens
  Payload ID: 2038;
  Gene Symbol: C1QTNF4;
  Gene Name: C1q and tumor necrosis  factor related prt 4;
  Uniprot ID:  Q9BXJ3;
  ENSP ID: ENSP00000302274
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDEVQALAFDEQRRPGARRAASQSAMLQLDYGDTVWLRLHGAPQYALGAPGATFSGYLVYADADADAPARGPPAPPEPRSAFSAARTRSLVGSDAGPGPRHQPLAFDTEFVNIGGDFDAAAGVFRCRLPGAYFFSFTLGKLPRKTLSVKLMKNRDEVQAMIYDDGASRRREMQSQSVMLALRRGDAVWLLSHDHDGYGAYSNHGKYITFSGFLVYPDLAPAAPPGLGASELL

SEQ ID NO: 10206 - protein, 100 aa, Homo sapiens
  Payload ID: 2038;
  Gene Symbol: C1QTNF4;
  Gene Name: C1q and tumor necrosis  factor related prt 4;
  ENSP ID: ENSP00000434548
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDE

SEQ ID NO: 10207 - protein, 243 aa, Homo sapiens
  Payload ID: 2039;
  Gene Symbol: C1QTNF5;
  Gene Name: C1q and tumor necrosis  factor related prt 5;
  Uniprot ID:  Q9BXJ0;
  ENSP ID: ENSP00000431140
MRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSAKRSESRVPPPSDAPLPFDRVLVNEQGHYDAVTGKFTCQVPGVYYFAVHATVYRASLQFDLVKNGESIASFFQFFGGWPKPASLSGGAMVRLEPEDQVWVQVGVGDYIGIYASIKTDSTFSGFLVYSDWHSSPVFA

SEQ ID NO: 10208 - protein, 243 aa, Homo sapiens; identical to SEQ ID NO: 10207
  Payload ID: 2039;
  Gene Symbol: C1QTNF5;
  Gene Name: C1q and tumor necrosis  factor related prt 5;
  Uniprot ID:  Q9BY79;
  ENSP ID: ENSP00000456533

SEQ ID NO: 10209 - protein, 60 aa, Homo sapiens
  Payload ID: 2039;
  Gene Symbol: C1QTNF5;
  Gene Name: C1q and tumor necrosis  factor related prt 5;
  ENSP ID: ENSP00000489201
MRPLLVLLLLGLAAGSPPLDDNKIPSLCPGHPGLPGLPGPRGDPGPRGEAGPAGPTGPAG

SEQ ID NO: 10210 - protein, 278 aa, Homo sapiens
  Payload ID: 2040;
  Gene Symbol: C1QTNF6;
  Gene Name: C1q and tumor necrosis  factor related prt 6;
  Uniprot ID:  Q9BXI9;
  ENSP ID: ENSP00000338812
MQWLRVRESPGEATGHRVTMGTAALGPVWAALLLFLLMCEIPMVELTFDRAVASGCQRCCDSEDPLDPAHVSSASSSGRPHALPEIRPYINITILKGDKGDPGPMGLPGYMGREGPQGEPGPQGSKGDKGEMGSPGAPCQKRFFAFSVGRKTALHSGEDFQTLLFERVFVNLDGCFDMATGQFAAPLRGIYFFSLNVHSWNYKETYVHIMHNQKEAVILYAQPSERSIMQSQSVMLDLAYGDRVWVRLFKRQRENAIYSNDFDTYITFSGHLIKAEDD

SEQ ID NO: 10211 - protein, 278 aa, Homo sapiens; identical to SEQ ID NO: 10210
  Payload ID: 2040;
  Gene Symbol: C1QTNF6;
  Gene Name: C1q and tumor necrosis  factor related prt 6;
  Uniprot ID:  Q9BXI9;
  ENSP ID: ENSP00000380299

SEQ ID NO: 10212 - protein, 116 aa, Homo sapiens
  Payload ID: 2040;
  Gene Symbol: C1QTNF6;
  Gene Name: C1q and tumor necrosis  factor related prt 6;
  ENSP ID: ENSP00000399243
MQWLRVRESPGEATGHRVTMGTAALGPVWAALLLFLLMCEIPMVELTFDRAVASGCQRCCDSEDPLDPAHVSSASSSGRPHALPEIRPYINITILKGRGRTRFPSRLWWLTAVTRP

SEQ ID NO: 10213 - protein, 296 aa, Homo sapiens
  Payload ID: 2041;
  Gene Symbol: C1QTNF7;
  Gene Name: C1q and tumor necrosis  factor related prt 7;
  Uniprot ID:  Q9BXJ2;
  ENSP ID: ENSP00000295297
MSRQEPKMFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 10214 - protein, 112 aa, Homo sapiens
  Payload ID: 2041;
  Gene Symbol: C1QTNF7;
  Gene Name: C1q and tumor necrosis  factor related prt 7;
  ENSP ID: ENSP00000371820
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEK

SEQ ID NO: 10215 - protein, 151 aa, Homo sapiens
  Payload ID: 2041;
  Gene Symbol: C1QTNF7;
  Gene Name: C1q and tumor necrosis  factor related prt 7;
  ENSP ID: ENSP00000380812
MSRQEPKMFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSI

SEQ ID NO: 10216 - protein, 289 aa, Homo sapiens
  Payload ID: 2041;
  Gene Symbol: C1QTNF7;
  Gene Name: C1q and tumor necrosis  factor related prt 7;
  Uniprot ID:  Q9BXJ2;
  ENSP ID: ENSP00000388914
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 10217 - protein, 289 aa, Homo sapiens; identical to SEQ ID NO: 10216
  Payload ID: 2041;
  Gene Symbol: C1QTNF7;
  Gene Name: C1q and tumor necrosis  factor related prt 7;
  Uniprot ID:  Q9BXJ2;
  ENSP ID: ENSP00000410722

SEQ ID NO: 10218 - protein, 252 aa, Homo sapiens
  Payload ID: 2042;
  Gene Symbol: C1QTNF8;
  Gene Name: C1q and tumor necrosis  factor related prt 8;
  Uniprot ID:  P60827;
  ENSP ID: ENSP00000330426
MAAPALLLLALLLPVGAWPGLPRRPCVHCCRPAWPPGPYARVSDRDLWRGDLWRGLPRVRPTIDIEILKGEKGEAGVRGRAGRSGKEGPPGARGLQGRRGQKGQVGPPGAACRRAYAAFSVGRREGLHSSDHFQAVPFDTELVNLDGAFDLAAGRFLCTVPGVYFLSLNVHTWNYKETYLHIMLNRRPAAVLYAQPSERSVMQAQSLMLLLAAGDAVWVRMFQRDRDNAIYGEHGDLYITFSGHLVKPAAEL

SEQ ID NO: 10219 - protein, 256 aa, Homo sapiens [sequence omitted]

SEQ ID NO: 10220 - protein, 333 aa, Homo sapiens
  Payload ID: 2043;
  Gene Symbol: C1QTNF9;
  Gene Name: C1q and tumor necrosis  factor related prt 9;
  Uniprot ID:  P0C862;
  ENSP ID: ENSP00000333737
MRIWWLLLAIEICTGNINSQDTCRQGHPGIPGNPGHNGLPGRDGRDGAKGDKGDAGEPGRPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDMPIKFDKILYNEFNHYDTAAGKFTCHIAGVYYFTYHITVFSRNVQVSLVKNGVKILHTKDAYMSSEDQASGGIVLQLKLGDEVWLQVTGGERFNGLFADEDDDTTFTGFLLFSSP

SEQ ID NO: 10221 - protein, 333 aa, Homo sapiens; identical to SEQ ID NO: 10220
  Payload ID: 2043;
  Gene Symbol: C1QTNF9;
  Gene Name: C1q and tumor necrosis  factor related prt 9;
  Uniprot ID:  P0C862;
  ENSP ID: ENSP00000371503

SEQ ID NO: 10222 - protein, 333 aa, Homo sapiens
  Payload ID: 2044;
  Gene Symbol: C1QTNF9B;
  Gene Name: C1q and tumor necrosis  factor related prt 9B;
  Uniprot ID:  B2RNN3;
  ENSP ID: ENSP00000371572
MRIWWLLLAIEICTGNINSQDTCRQGHPGIPGNPGHNGLPGRDGRDGAKGDKGDAGEPGCPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDVPIKFDKILYNEFNHYDTAVGKFTCHIAGVYYFTYHITVFSRNVQVSLVKNGVKILHTRDAYVSSEDQASGSIVLQLKLGDEMWLQVTGGERFNGLFADEDDDTTFTGFLLFSSQ

SEQ ID NO: 10223 - protein, 333 aa, Homo sapiens; identical to SEQ ID NO: 10222
  Payload ID: 2044;
  Gene Symbol: C1QTNF9B;
  Gene Name: C1q and tumor necrosis  factor related prt 9B;
  Uniprot ID:  B2RNN3;
  ENSP ID: ENSP00000371575

SEQ ID NO: 10224 - protein, 99 aa, Homo sapiens
  Payload ID: 2044;
  Gene Symbol: C1QTNF9B;
  Gene Name: C1q and tumor necrosis  factor related prt 9B;
  ENSP ID: ENSP00000371580
MRIWWLLLAIEICTGNINSQDTCRQGHPGIPGNPGHNGLPGRDGRDGAKGDKGDAGEPGCPGSPGKDGTSGEKGERGADGKVEAKGIKGMFRCLWSKTE

SEQ ID NO: 10225 - protein, 284 aa, Homo sapiens
  Payload ID: 2045;
  Gene Symbol: C1QTNF3-AMACR;
  Gene Name: C1QTNF3-AMACR readthrough (NMD candidate);
  ENSP ID: ENSP00000371511
MTKSSLRPLQKQSPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETKCHGETPAGPRDSAAGKSKAYLCQAEWIWPVRKLLPVSWPRYQLFGFVRWKEQHI

SEQ ID NO: 10226 - protein, 100 aa, Homo sapiens
  Payload ID: 2046;
  Gene Symbol:;
  Gene Name: C1QTNF9B antisense RNA 1 [Source:EntrezGene;Acc:542767];
  ENSP ID: ENSP00000487130
MGISEEGNLLSTVSPTVKALFGKTRVSPIFPFSPRSPFQPLIPRTPGSPWGPVGPASPLGPGFPIGPMGPGKPVGPKGPMLPLGPSGPVGPTSPLFPFCP

SEQ ID NO: 10227 - protein, 541 aa, Homo sapiens
  Payload ID: 2047;
  Gene Symbol: C2CD2;
  Gene Name: C2 calcium-dependent domain containing 2;
  Uniprot ID:  Q9Y426;
  ENSP ID: ENSP00000329302
MRLSPFHLQLEFHMKEKREDLQISWSFISVPEMAVNIQPKALGEDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTVMPCGTVVTTVTAVKTKPRVDVGRASPLSSDSPVKTPIKVKVIEKDISVQAIACRSAPVSKTLSSSDTELLVLNGSDPVAEVAIRQLSESSKLKLKSPRKKSTIIISGISKTSLSQDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 10228 - protein, 696 aa, Homo sapiens
  Payload ID: 2047;
  Gene Symbol: C2CD2;
  Gene Name: C2 calcium-dependent domain containing 2;
  Uniprot ID:  Q9Y426;
  ENSP ID: ENSP00000369853
MAMARLGSWLGEAQWLALVSLFVAALATVGLYLAQWALARARPQPQRRAVEPGEGPRPGSDALLSWILTLGSWRSQWQAAWVTALNEEAERKGGPPFLSFEEDPRQQALELVVQEVSSVLRSAEEKVVVCHVVGQAIQFLVSETPALGAGCRLYDMRLSPFHLQLEFHMKEKREDLQISWSFISVPEMAVNIQPKALGEDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTVMPCGTVVTTVTAVKTKPRVDVGRASPLSSDSPVKTPIKVKVIEKDISVQAIACRSAPVSKTLSSSDTELLVLNGSDPVAEVAIRQLSESSKLKLKSPRKKSTIIISGISKTSLSQDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 10229 - protein, 182 aa, Homo sapiens
  Payload ID: 2047;
  Gene Symbol: C2CD2;
  Gene Name: C2 calcium-dependent domain containing 2;
  ENSP ID: ENSP00000388704
  MOD_RES (1)..(1): Any amino acid
XSTIIISGISKDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 10230 - protein, 1963 aa, Homo sapiens
  Payload ID: 2048;
  Gene Symbol: C2CD3;
  Gene Name: C2 calcium-dependent domain containing 3;
  Uniprot ID:  Q4AC94;
  ENSP ID: ENSP00000323339
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPPINEDSLRASTQIRAFSRNRFKDHIEDHLLPSTENTFWRHDTKADTRAIQLLLGSAELSQGNFWDGLGSPPDSPSPGSDVYCISELNDPQYDQSLLENLFYTAPKSDTSISDFLSEEDDIVPSKKISQSTALARSSKVLESSDHKLKKRSAGKRNRNLVEQQMLSETPEDAQTMTLSVDRLALLGRTHSVRIIIETMGVPPDSPQMTPGKKSYAGPPPKVTTAKKRTFFVEYHFPVGFSESGLGKTALITEVVRLASSKITDGKVKFQQRFVFPVQFGGPMIEHWWNSNLTFQIYVKKTPQKKPEVIGSVSLSLRAVIQSELLSFSDQLPVQQENGQSPFGPLKVTMELITDNKDFTGINTKLSGNTHYTPLCAPTSPNKALPELNQDMTCTKNPQNLNQIHEETAKKAQNLVLPNRKSPSPVAPHPSTFVATPASHNLVNQTNGTTKESALLLHVLLMVPDGKDFISGESEKQSPCNVYLNCKLFSTEEVTRSVIAWGTTQPVFNFSQVIPVSLSSKYLERLKNNVMVIETWNKVRSPGQDKLLGLVKLPLHQFYMSFKDAKISRLLLDAQYPVVAVDSYMPVIDVFSGHQNGSLRVFLAMGSSNQIMALQRLKNEEGTLPPFSPRPAHFLDQPTAASVAMAEDRGNGLMEHCFEIHIEMVKGLAPLQATVWGEADCYVQYYFPVQHSQSSVLKGPEFLENGITLKPFRTATTLCVPDPIFNSEHHHSLLLPAEVPVQRLLLSAFSAQGLVPGGGVQFEIWCRYYYPNVRDQKVAKGTLPLSRICAMVTTQHREDVGIQTFNLPLTPRIENRKELRNQSSGLLDVGLRYRRSPRTAEGVLAARTVSISVQIIRACGLQAAAKALAEREPALQFSATVGVNASVTTHLSFLPQGEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITGSY

SEQ ID NO: 10231 - protein, 2353 aa, Homo sapiens
  Payload ID: 2048;
  Gene Symbol: C2CD3;
  Gene Name: C2 calcium-dependent domain containing 3;
  Uniprot ID:  Q4AC94;
  ENSP ID: ENSP00000334379
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPPINEDSLRASTQIRAFSRNRFKDHIEDHLLPSTENTFWRHDTKADTRAIQLLLGSAELSQGNFWDGLGSPPDSPSPGSDVYCISELNDPQYDQSLLENLFYTAPKSDTSISDFLSEEDDIVPSKKISQSTALARSSKVLESSDHKLKKRSAGKRNRNLVEQQMLSETPEDAQTMTLSVDRLALLGRTHSVRIIIETMGVPPDSPQMTPGKKSYAGPPPKVTTAKKRTFFVEYHFPVGFSESGLGKTALITEVVRLASSKITDGKVKFQQRFVFPVQFGGPMIEHWWNSNLTFQIYVKKTPQKKPEVIGSVSLSLRAVIQSELLSFSDQLPVQQENGQSPFGPLKVTMELITDNKDFTGINTKLSGNTHYTPLCAPTSPNKALPELNQDMTCTKNPQNLNQIHEETAKKAQNLVLPNRKSPSPVAPHPSTFVATPASHNLVNQTNGTTKESALLLHVLLMVPDGKDFISGESEKQSPCNVYLNCKLFSTEEVTRSVIAWGTTQPVFNFSQVIPVSLSSKYLERLKNNVMVIETWNKVRSPGQDKLLGLVKLPLHQFYMSFKDAKISRLLLDAQYPVVAVDSYMPVIDVFSGHQNGSLRVFLAMGSSNQIMALQRLKNEEGTLPPFSPRPAHFLDQPTAASVAMAEDRGNGLMEHCFEIHIEMVKGLAPLQATVWGEADCYVQYYFPVQHSQSSVLKGPEFLENGITLKPFRTATTLCVPDPIFNSEHHHSLLLPAEVPVQRLLLSAFSAQGLVPGGGVQFEIWCRYYYPNVRDQKVAKGTLPLSRICAMVTTQHREDVGIQTFNLPLTPRIENRKELRNQSSGLLDVGLRYRRSPRTAEGVLAARTVSISVQIIRACGLQAAAKALAEREPALQFSATVGVNASVTTHLSFLPQGEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITDLQTITRDSQAALSSHRARSRSNKATTLPDAQDTEALQERCTMPDEPLVRAPDKGTDSPSPPPLEETSNGGRMLHESLRHAVPITRMQSSEDTEAGPAYSDEDYEEDIIEPRTLNEITTVTDKTSPWSSVISDTSEVISPQPDEVQREGPSCPSPGPFCREELMVKSSFLSSPERAVNPHLPRQGSPSQSLVACECEASKARVGGESASANPQPIPCPTLSGAQQSSTFVGWSSPQTDQNKEPKSEAPAENEAATSELGDSADSFKKLPLNLASQSRRENHKGPPIDSSDIRQRQVTTGSETSTKQSLLLPGPIVVPNFFLPPQQLEASLRMLSLSATLPPAATTDQDKSEATRGALSQRPCRPRPNSLPLNLPEEETLRIARIFSSQYSQKD

SEQ ID NO: 10232 - protein, 776 aa, Homo sapiens
  Payload ID: 2048;
  Gene Symbol: C2CD3;
  Gene Name: C2 calcium-dependent domain containing 3;
  ENSP ID: ENSP00000388750
AARTVSISVQIIRACGLQAAAKALAEREPALQFSATVGVNASVTTHLSFLPQGEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRKNLSELDQIQRYFRQKLTKPFLPLSPQTQTAISQHQESCRDHLGPGASSLDPGSQCILEKSSNLVLQVSSLITGLPAPNDS

SEQ ID NO: 10233 - protein, 677 aa, Homo sapiens
  Payload ID: 2048;
  Gene Symbol: C2CD3;
  Gene Name: C2 calcium-dependent domain containing 3;
  ENSP ID: ENSP00000404577
GEQRRTHPVACSFCPEFSHHVEFTCNLVTQHCSGEACFLAELLEFAEVIFAVYHENTKSASDIISIESCKEYLLGVVKVPTKELLIKRSGITGWYPIILPEDGGLPHGLELMQKIVGGLELSISFTHRGDRERVLEAAEHLGWSFENSLKDFVRMDEGEPATVTISTPRLWLPIHCVLLAGHNHIHKNTYCYLRYKFYDHEAFWTPLKKPKESVNKKQIMVTFKASKRAEVTRGPSLLWYFREERLEIQVWRAYGNDSVERPHQTDSWIGSAYVDLARLGERSARTLTVSGVYPLFGRNASNLSGAALRVHVVLSSLSSHLEPTHELDSMDCSSHSESEQLPRRNDEVQLSPPEVISCHQKSPASTQVPCSSTTAEVRLTQEGPADLDGTFAVSILVERAMHLSLKGSPLTERKVSIPSCCVSFATADESSPVYTQVVENTDSPIWNFQQQSRLSKELLLDPQQTLVFKVWHKGDEERVIGFASVDLSPLLSGFQFVCGWYNITDFSGECQGQIKVAVSPLESLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLRSSPSLSYPSALRLKRPSHSTRRAVGTILGQVPAA

SEQ ID NO: 10234 - protein, 191 aa, Homo sapiens
  Payload ID: 2048;
  Gene Symbol: C2CD3;
  Gene Name: C2 calcium-dependent domain containing 3;
  ENSP ID: ENSP00000439343
YKGSWVTEYENSADSRLGTRRLSPEGGALFRAMHPAQWSPQRAHPYALAQLEAPPSQPRRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTI

SEQ ID NO: 10235 - protein, 171 aa, Homo sapiens
  Payload ID: 2048;
  Gene Symbol: C2CD3;
  Gene Name: C2 calcium-dependent domain containing 3;
  ENSP ID: ENSP00000441742
  MOD_RES (1)..(1): Any amino acid
XLIHFKEERQARRGVETSKSLIPIYSPFSFPASDTYAAFSSHMARQTLDQLAHASSKELDFSSPGRSDTTRSQASRHEEHVQNIRRFHESLHLQGEAPLPCDDKLTTSPLSSQTSILTSLSPQTQTAISQHQESCRDHLGPGASSLDPGSQCILEKSSNLVLQVSSLITDT

SEQ ID NO: 10236 - protein, 506 aa, Homo sapiens
  Payload ID: 2048;
  Gene Symbol: C2CD3;
  Gene Name: C2 calcium-dependent domain containing 3;
  ENSP ID: ENSP00000445933
MKQRKGQGSGGSRGRKKRGLSDISPSTSLPPLVEGQLRCFLKLTVNRVIWKIAKPPTCVLVRVRWWGETSDGTLFCPRDALQTEPKAVRTTTRYAIRCGPKQFTSYLTDMAVLVLEVITKLDGLPIGRVQINGLAQLSPTHQINGFFTIVSSTSKKLGELQVSLALEPLSETYDSYHPLPTTDMTENVLLSKQGFRENTEPSSTQFQVPSRPRDIHTIKIDGKELAANSSRSTTPRGKDHVCFAENPDTIKDSSFGLQHSLNSGQSLESVTLKGRAPRKQMSLLNSSEFQPQIRTVAKSHSDSCILSSNNLPTKDLLSALLEQGNKLRNAMVISAMKSSPETSMLLDQVHPPINEDSLRASTQIRAFSRNRFKDHIEDHLLPSTENTFWRHDTKADTRAIQLLLGSLGLTRCRDCRRSLVHAVLNGAQAGVQWRDIGSLQPPPPSRLPWPPKVPRLQPLPGRHPVWEVRSVSAWPPIVWDVRIPSAWLPSLESEERLCPPAIPSRK

SEQ ID NO: 10237 - protein, 369 aa, Homo sapiens
  Payload ID: 2049;
  Gene Symbol: C2CD4A;
  Gene Name: C2 calcium-dependent domain containing 4A;
  Uniprot ID:  Q8NCU7;
  ENSP ID: ENSP00000347712
MWCLERLRLGPECLRRSGDWLLPGRARGAKSRTTAACANVLTPDRIPEFCIPPRLMPRLALAALRNSWVEEAGMDEGAGRTDWDPRSQAALSLPHLPRVRTAYGFCALLESPHTRRKESLLLGGPPAPRPRAHTYGGGGGPDALLGTLRVPRAPGPATPAAPGCPRPPQDALARRPRGCRLLRVPDGLLSRALRAGRSRRLTRVRSVSSGNEDKERRAGSQSPARAPSTSPPSSRVPFPERLEAEGTVALGRAGDALRLAAEYCPGTGRLRLRLLRAESPAGGAPGPRAVSCRLSLVLRPPGTALRQCSTVVGRSRKASFDQDFCFDGLSEDEVRRLAVRVKARDEGRGRERGRLLGQGELSLGALLLL

SEQ ID NO: 10238 - protein, 364 aa, Homo sapiens
  Payload ID: 2050;
  Gene Symbol: C2CD4B;
  Gene Name: C2 calcium-dependent domain containing 4B;
  Uniprot ID:  A6NLJ0;
  ENSP ID: ENSP00000369755
MRLLEKLCSSAAGSSAPKPAFAKVLTPNRIPEFCIPPRLPAPCTLESPIRAAAVPRRCAAESDLWPRAADEDAGRTDWDPRSQAALSLPHLPRVRTTYGFCALLESPHTRRKESLLLGGPPAPRPRAHSCGGGGGPDAPLGTLCGPRGPGPATPAAPGGPRLPQDALAAGPRRCRLLRVPDGLLSRALRAGRSRRLARVRSVSSGNEDEERRAGSESPARAPSSSPLSSRAPLPERLEAKGTVALGRAGDALRLAAEYCPGTRRLRLRLLRAESLFGGAPGPRAVRCRLSLVLRPPGTARWQCSAVVGRSRKASFDQDFCFDGLSEDEVRRLAVRVKARDEGRGRDRGRLLGQGELSLGALLLL

SEQ ID NO: 10239 - protein, 421 aa, Homo sapiens
  Payload ID: 2051;
  Gene Symbol: C2CD4C;
  Gene Name: C2 calcium-dependent domain containing 4C;
  Uniprot ID:  Q8TF44;
  ENSP ID: ENSP00000328677
MRKTNMWFLERLRGSGENGAARGVGSEAGDKASKGPLYSNVLTPDKIPDFFIPPKLPSGPAEGEGQAALGPSTSEQNLASAAPRQTPRSPRLPAKLAAESKSLLKAATRHVIQIESAEDWLSEEATDADPQAQGAMSLPSVPKAQTSYGFAMLAESPHTRRKESLFHSEHGALAQVGSPGAGRRRAAAKANGGDGGPREAGGALMSPGRYFSGGESDTGSSAESSPFGSPLLSRSVSLLKGFAQDSQAKVSQLRHSVGRHGSLSADDSTPDASPGSRRRLTRRAPPEPGPESGQARGEHTVHVGPRGSVRLLAEYEAGQARLRVHLLAAEGLYDRLCDARSINCCVGLCLVPGKLQKQRSTIVKNSRRPVFNEDFFFDGLGPASVRKLALRIKVVNKGSSLKRDTLLGEKELPLTSLLPFL

SEQ ID NO: 10240 - protein, 353 aa, Homo sapiens
  Payload ID: 2052;
  Gene Symbol: C2CD4D;
  Gene Name: C2 calcium-dependent domain containing 4D;
  Uniprot ID:  B7Z1M9;
  ENSP ID: ENSP00000389554
MWLLEKAGYKVGAAEPAARWAPSGLFSKRRAPGPPTSACPNVLTPDRIPQFFIPPRLPDPGGAVPAARRHVAGRGLPATCSLPHLAGREGWAFLPESPHTRRRESLFHGPPPAPAGGLPAAQSRLHVSAPDLRLCRAPDSDTASSPDSSPFGSPRPGLGRRRVSRPHSLSPEKASSADTSPHSPRRAGPPTPPLFHLDFLCCQLRPTRESVLRLGPRGGQLRLSTEYQAGPGRLRLRLVSAEGLPRPRSRPGSGGGGCCVVLRLRPRVRPREQQSRVVKCSANPIFNEDFFFDGLGPPDLAARSLRAKVLDRGAGLRRDVLLGECETPLIALLPPLGGGLGPGSSLAPTHLSL

SEQ ID NO: 10241 - protein, 1000 aa, Homo sapiens
  Payload ID: 2053;
  Gene Symbol: C2CD5;
  Gene Name: C2 calcium-dependent domain containing 5;
  Uniprot ID:  Q86YS7;
  ENSP ID: ENSP00000334229
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKEIPFNEDPNPNTHSSGPSTPLKNQTYSFSPSKSYSRQSSSSDTDLSLTPKTGMGSGSAGKEGGPFKALLRQQTQSALEQREFPFFTLTAFPPGFLVHVGGVVSARSVKLLDRIHNPDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKAMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 10242 - protein, 1042 aa, Homo sapiens
  Payload ID: 2053;
  Gene Symbol: C2CD5;
  Gene Name: C2 calcium-dependent domain containing 5;
  Uniprot ID:  Q86YS7;
  ENSP ID: ENSP00000379345
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKESPLVHPPSHGCRSTHNSPIHTATGSRLTQNFSVSVPTLIYTGMGSGSAGKEGGPFKALLRQQTQSALEQREFPFFTLTAFPPGFLVHVGGVVSARSVKLLDRIHNPDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKEHLESASSNSGIPAAQRATSVDYSSFADRCSSWIELIKLKAQTIRRGSIKTTMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 10243 - protein, 1051 aa, Homo sapiens
  Payload ID: 2053;
  Gene Symbol: C2CD5;
  Gene Name: C2 calcium-dependent domain containing 5;
  Uniprot ID:  Q86YS7;
  ENSP ID: ENSP00000388756
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKEIPFNEDPNPNTHSSGPSTPLKNQTYSFSPSKSYSRQSSSSDTDLSLTPKTGMGSGSAGKEGGPFKALLRQQTQSALEQREFPFFTLTAFPPGFLVHVGGVVSARSVKLLDRIHNPDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKEHLESASSNSGIPAAQRATSVDYSSFADRCSSWIELIKLKAQTIRRGSIKTTMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 10244 - protein, 283 aa, Homo sapiens
  Payload ID: 2053;
  Gene Symbol: C2CD5;
  Gene Name: C2 calcium-dependent domain containing 5;
  ENSP ID: ENSP00000437935
  MOD_RES (1)..(1): Any amino acid
XWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKEHLESASSNSGIPAAQRAMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSS

SEQ ID NO: 10245 - protein, 165 aa, Homo sapiens
  Payload ID: 2053;
  Gene Symbol: C2CD5;
  Gene Name: C2 calcium-dependent domain containing 5;
  ENSP ID: ENSP00000438256
  MOD_RES (1)..(1): Any amino acid
XMSGELQRKIGLKVLEMRGNAVVGYLQCFDLEGESGLVVRAIGTACTLDKLSSPAAFLPACNSPSKEMKEIPFNEDPNPNTHSSGPSTPLKNQTYSFSPSKSYSRQSSSSDTDLSLTPKTGMGSGSAGKEGGPFKALLRQQTQSALEQRMNQKLEMHGGQKSDKK

SEQ ID NO: 10246 - protein, 1053 aa, Homo sapiens
  Payload ID: 2053;
  Gene Symbol: C2CD5;
  Gene Name: C2 calcium-dependent domain containing 5;
  Uniprot ID:  Q86YS7;
  ENSP ID: ENSP00000439392
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKESPLVHPPSHGCRSTHNSPIHTATGSRLTQNFSVSVPTLIYTGMGSGSAGKEGGPFKALLRQQTQSALEQRGGSPHRFCRRREFPFFTLTAFPPGFLVHVGGVVSARSVKLLDRIHNPDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKEHLESASSNSGIPAAQRATSVDYSSFADRCSSWIELIKLKAQTIRRGSIKTTMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 10247 - protein, 1051 aa, Homo sapiens; identical to SEQ ID NO: 10243
  Payload ID: 2053;
  Gene Symbol: C2CD5;
  Gene Name: C2 calcium-dependent domain containing 5;
  Uniprot ID:  Q86YS7;
  ENSP ID: ENSP00000441951

SEQ ID NO: 10248 - protein, 1054 aa, Homo sapiens
  Payload ID: 2053;
  Gene Symbol: C2CD5;
  Gene Name: C2 calcium-dependent domain containing 5;
  Uniprot ID:  Q86YS7;
  ENSP ID: ENSP00000443204
MPGKLKVKIVAGRHLPVMDRASDLTDAFVEVKFGNTTFKTDVYLKSLNPQWNSEWFKFEVDDEDLQDEPLQITVLDHDTYSANDAIGKVYIDIDPLLYSEAATVISGWFPIYDTIHGIRGEINVVVKVDLFNDLNRFRQSSCGVKFFCTTSIPKCYRAVIIHGFVEELVVNEDPEYQWIDRIRTPRASNEARQRLISLMSGELQRKIGLKVLEMRGNAVVGYLQCFDLEGESGLVVRAIGTACTLDKLSSPAAFLPACNSPSKEMKESPLVHPPSHGCRSTHNSPIHTATGSRLTQNFSVSVPTLIYTGMGSGSAGKEGGPFKALLRQQTQSALEQREFPFFTLTAFPPGFLVHVGGVVSARSVKLLDRIHNPAFVGIMGNTRSYKLLDWNSFNSDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCYNCRKQKVPDVLFTTIDLPTDATVIGKGCLIQARLCRLKKKAQAEANATAISNLLPFMEYEVHTQLMNKLKLKGMNALFGLRIQITVGENMLMGLASATGVYLAALPTPGGIQIAGKTPNDGSYEQHISHMQKKINDTIAKNKELYEINPPEISEEIIGSPIPEPRQRSRLLRSQSESSDEVTELDLSHGKKDAFVLEIDDTDAMEDVHSLLTDVPPPSGFYSCNTEIMPGINNWTSEIQMFTSVRVIRLSSLNLTNQALNKNFNDLCENLLKSLYFKLRSMIPCCLCHVNFTVSLPEDELIQVTVTAVAITFDKNQALQTTKTPVEKSLQRASTDNEELLQFPLELCSDSLPSHPFPPAKEHLESASSNSGIPAAQRDRCSSWIELIKLKAQTIRRGSIKTTMTVEKASPVGDGNFRNRSAPPCANSTVGVVKMTPLSFIPGAKITKYLGIINMFFIRETTSLREEGGVSGFLHAFIAEVFAMVRAHVAALGGNAVVSYIMKQCVFMENPNKNQAQCLINVSGDAVVFVRESDLEVVSSQQPTTNCQSSCTEGEVTT

SEQ ID NO: 10249 - protein, 182 aa, Homo sapiens
  Payload ID: 2053;
  Gene Symbol: C2CD5;
  Gene Name: C2 calcium-dependent domain containing 5;
  ENSP ID: ENSP00000444857
  MOD_RES (1)..(1): Any amino acid
XQQTQSALEQRGGSPHRFCRRREFPFFTLTAFPPGFLVHVGGVVSARSVKLLDRIHNPAFVGIMGNTRSYKLLDWNSFNSDEPETRDAWWAEIRQEIKSHAKALGCHAVVGYSESTSICEEVCILSASGTAAVLNPRFLQDGTVEGCLEQRLEENLPTRCGFCHIPYDELNMPFPAHLTYCY

SEQ ID NO: 10250 - protein, 79 aa, Homo sapiens
  Payload ID: 2054;
  Gene Symbol: C21orf62-AS1;
  Gene Name: C21orf62 antisense RNA 1;
  Uniprot ID:  Q17RA5;
  ENSP ID: ENSP00000459537
MHHVRQLMMPICPMALNSTTSSSTTFGAFRIMTLNVEEWATAWKVLILLEAAVEEEKRSEEKRILVCGTCGTRSSQKNL

SEQ ID NO: 10251 - protein, 14 aa, Homo sapiens
  Payload ID: 2054;
  Gene Symbol: C21orf62-AS1;
  Gene Name: C21orf62 antisense RNA 1;
  ENSP ID: ENSP00000460208
MHHVRQLMMPICPM

SEQ ID NO: 10252 - protein, 49 aa, Homo sapiens
  Payload ID: 2054;
  Gene Symbol: C21orf62-AS1;
  Gene Name: C21orf62 antisense RNA 1;
  ENSP ID: ENSP00000460870
MHHVRQLMMPICPMVLILLEAAVEEEKRSEEKRILVCGTCGTRSSQKNL

SEQ ID NO: 10253 - protein, 79 aa, Homo sapiens; identical to SEQ ID NO: 10250
  Payload ID: 2054;
  Gene Symbol: C21orf62-AS1;
  Gene Name: C21orf62 antisense RNA 1;
  Uniprot ID:  Q17RA5;
  ENSP ID: ENSP00000461835

SEQ ID NO: 10254 - protein, 707 aa, Homo sapiens
  Payload ID: 2055;
  Gene Symbol: C2CD2L;
  Gene Name: C2CD2-like;
  Uniprot ID:  O14523;
  ENSP ID: ENSP00000338885
MDPGWGQRDVGWAALLILFAASLLTVFAWLLQYARGLWLARARGDRGPGPALAGEPAGSLRELGVWRSLLRLRATRAGAAEEPGVRGLLASLFAFKSFRENWQRAWVRALNEQACRNGSSIQIAFEEVPQLPPRASISHVTCVDQSEHTMVLRCQLSAEEVRFPVSVTQQSPAAVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSPGDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 10255 - protein, 391 aa, Homo sapiens
  Payload ID: 2055;
  Gene Symbol: C2CD2L;
  Gene Name: C2CD2-like;
  ENSP ID: ENSP00000433600
MMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKASPLPLQ

SEQ ID NO: 10256 - protein, 550 aa, Homo sapiens
  Payload ID: 2056;
  Gene Symbol: CPAMD8;
  Gene Name: C3 and PZP-like, alpha-2-macroglobulin domain containing 8;
  Uniprot ID:  Q8IZJ3;
  ENSP ID: ENSP00000291440
MAPGALRGGCEQRAPGGGARTAALGPWPWPSPGPAPSPGAAPPRSRKMSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLEVFQELEDYDVSDSFGVSREDGPFWWAGLTAQRRRRSSVFPWPWGITKDSGFAFTVRRGNGTGGDDRPSEPEPPAGRWPLHR

SEQ ID NO: 10257 - protein, 503 aa, Homo sapiens
  Payload ID: 2056;
  Gene Symbol: CPAMD8;
  Gene Name: C3 and PZP-like, alpha-2-macroglobulin domain containing 8;
  ENSP ID: ENSP00000373577
MSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLEVFQELEDYDVSDSFGVSREDGPFWWAGLTAQRRRRSSVFPWPWGITKDSGFAFTVRRGNGTGGDDRPSEPEPPAGRWPLHR

SEQ ID NO: 10258 - protein, 1932 aa, Homo sapiens
  Payload ID: 2056;
  Gene Symbol: CPAMD8;
  Gene Name: C3 and PZP-like, alpha-2-macroglobulin domain containing 8;
  Uniprot ID:  Q8IZJ3;
  ENSP ID: ENSP00000402505
MAPGALRGGCEQRAPGGGARTAALGPWPWPSPGPAPSPGAAPPRSRKMSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDRVTAGPRPPVSSGNLESSTQSASPFHRWGQTPAPQRHSGRVVGAHRPGLLSPVFVYSPAFQSGGEEGLWMSNTCTLR

SEQ ID NO: 10259 - protein, 175 aa, Homo sapiens
  Payload ID: 2056;
  Gene Symbol: CPAMD8;
  Gene Name: C3 and PZP-like, alpha-2-macroglobulin domain containing 8;
  ENSP ID: ENSP00000469163
LLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALAGREAEWS

SEQ ID NO: 10260 - protein, 338 aa, Homo sapiens
  Payload ID: 2056;
  Gene Symbol: CPAMD8;
  Gene Name: C3 and PZP-like, alpha-2-macroglobulin domain containing 8;
  ENSP ID: ENSP00000471545
  MOD_RES (1)..(1): Any amino acid
XVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDSQSGFSS

SEQ ID NO: 10261 - protein, 56 aa, Homo sapiens
  Payload ID: 2056;
  Gene Symbol: CPAMD8;
  Gene Name: C3 and PZP-like, alpha-2-macroglobulin domain containing 8;
  ENSP ID: ENSP00000473216
RTQTLSLKGRRRTERLLFLTAALLRAGRHHLAASCPYQPVTLYGGWADLSPGDTCL

SEQ ID NO: 10262 - protein, 458 aa, Homo sapiens
  Payload ID: 2057;
  Gene Symbol: C7orf55-LUC7L2;
  Gene Name: C7orf55-LUC7L2 readthrough;
  ENSP ID: ENSP00000440222
MAALGSPSHTFRGLLRELRYLSAATGRPYRDTAAYRYLVKAFRAHRVTSEKLCRAQHELHFQAATYLCLLRSIRKHVALHQEFHGKGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 10263 - protein, 496 aa, Homo sapiens
  Payload ID: 2058;
  Gene Symbol: C8orf44-SGK3;
  Gene Name: C8orf44-SGK3 readthrough;
  ENSP ID: ENSP00000429022
MQRDHTMDYKESCPSVSIPSSDEHREKKKRFTVYKVLVSVGRSEWFVFRRYAEFDKLYNTLKKQFPAMALKIPAKRIFGDNFDPDFIKQRRAGLNEFIQNLVRYPELYNHPDVRAFLQMDSPKHQSDPSEDEDERSSQKLHSTSQNINLGPSGNPHAKPTDFDFLKVIGKGSFGKVLLAKRKLDGKFYAVKVLQKKIVLNRKEQKHIMAERNVLLKNVKHPFLVGLHYSFQTTEKLYFVLDFVNGGELFFHLQRERSFPEHRARFYAAEIASALGYLHSIKIVYRDLKPENILLDSVGHVVLTDFGLCKEGIAISDTTTTFCGTPEYLAPEVIRKQPYDNTVDWWCLGAVLYEMLYGLPPFYCRDVAEMYDNILHKPLSLRPGVSLTAWSILEELLEKDRQNRLGAKEDFLEIQNHPFFESLSWADLVQKKIPPPFNPNVAGPDDIRNFDTAFTEETVPYSVCVSSDYSIVNASVLEADDAFVGFSYAPPSEDLFL
